US007790867B2

(12) United States Patent
Bentwich

(10) Patent No.: US 7,790,867 B2
(45) Date of Patent: Sep. 7, 2010

(54) VACCINIA VIRUS-RELATED NUCLEIC ACIDS AND MICRORNA

(75) Inventor: Itzhak Bentwich, Kfar Daniel (IL)

(73) Assignee: Rosetta Genomics Inc., Rehovot (IL)

( * ) Notice: Subject to any disclaimer, the term of this patent is extended or adjusted under 35 U.S.C. 154(b) by 732 days.

(21) Appl. No.: 10/604,943

(22) Filed: Aug. 28, 2003

(65) Prior Publication Data

US 2007/0031823 A1   Feb. 8, 2007

Related U.S. Application Data

(60) Provisional application No. 60/441,241, filed on Jan. 17, 2003.

(51) Int. Cl.
*C07H 21/02* (2006.01)
*C07H 21/04* (2006.01)
*C12Q 1/68* (2006.01)
*C12N 5/00* (2006.01)
*A01N 43/04* (2006.01)
*A61K 31/70* (2006.01)

(52) U.S. Cl. .................. 536/23.1; 536/24.5; 435/6; 435/375; 514/44

(58) Field of Classification Search .............. 702/2; 424/199.1, 93.2; 435/6, 375; 536/23.1, 24.5; 800/298
See application file for complete search history.

(56) References Cited

U.S. PATENT DOCUMENTS

| 5,744,140 | A | * | 4/1998 | Paoletti et al. ............ 424/199.1 |
| 6,107,091 | A | * | 8/2000 | Cowsert ...................... 435/375 |
| 6,506,559 | B1 | * | 1/2003 | Fire et al. ......................... 435/6 |
| 6,903,247 | B2 | * | 6/2005 | Aldwinckle et al. .......... 800/298 |
| 2001/0053519 | A1 | * | 12/2001 | Fodor et al. ..................... 435/6 |
| 2002/0086356 | A1 | | 7/2002 | Tuschl et al. |
| 2004/0146910 | A1 | * | 7/2004 | Zhou .............................. 435/6 |

FOREIGN PATENT DOCUMENTS

| WO | WO 0130362 | A2 | * | 5/2001 |
| WO | WO 01/68836 | | | 9/2001 |
| WO | WO 02/44321 | | | 6/2002 |
| WO | WO 02/094185 | | | 11/2002 |
| WO | WO 02088162 | A1 | * | 11/2002 |
| WO | WO 2005001128 | A2 | * | 1/2005 |

OTHER PUBLICATIONS

Opalinska et al., Nucleic-acid therapeutics: basic principles and recent applications, Jul. 2002, Nature Reviews Drug Discovery, vol. 1, pp. 503-514.*
Lee, R. C., R. L. Feinbaum and V. Ambros. The *C. elegans* heterochronic gene lin-4 encodes small RNAs with antisense complementarity to lin-14 Cell Dec. 3, 1993 843-854 75.
Wightman, B., I. Ha and G. Ruvkun. Posttranscriptional regulation of the heterochronic gene lin-14 by lin-4 mediates temporal pattern formation in *C. elegans* Cell Dec. 3, 1993 855-862 75.
Gallinaro, H., L. Domenjoud and M. Jacob. Structural study of the 5' end of a synthetic premessenger RNA from adenovirus. Evidence for a long-range exon-intron interaction J Mol Biol Jul. 15, 1994 205-225 240.
Lu, C. and R. Bablanian. Characterization of small nontranslated polyadenylylated RNAs in vaccinia virus-infected cells Proc Natl Acad Sci U S A Mar. 5, 1996 2037-2042 93.
Crawford, E. D., E. P. Deantoni, R. Etzioni, V. C. Schaefer, R. M. Olson and C. A. Ross. Serum prostate-specific antigen and digital rectal examination for early detection of prostate cancer in a national community-based program. The Prostate Cancer Education Council Urology Jun. 1996 863-869 47.
Engdahl HM, Hjalt TA, Wagner EG. A two unit antisense RNA cassette test system for silencing of target genes. Nucleic Acids Res. Aug. 15, 1997 3218-27 25.
Smith, D. S., P. A. Humphrey and W. J. Catalona. The early detection of prostate carcinoma with prostate specific antigen: the Washington University experience Cancer Nov. 1, 1997 1852-1856 80.
Dsouza, M., N. Larsen and R. Overbeek. Searching for patterns in genomic data Trends Genet Dec. 1997 497-498 13.
Moss, E. G., R. C. Lee and V. Ambros. The cold shock domain protein LIN-28 controls developmental timing in *C. elegans* and is regulated by the lin-4 RNA Cell 1997 637 88.
Fire, A., S. Xu, M. K. Montgomery, S. A. Kostas, S. E. Driver and C. C. Mello. Potent and specific genetic interference by double-stranded RNA in *Caenorhabditis elegans* Nature Feb. 19, 1998 806-811 391.
Waterhouse, P. M., M. W. Graham and M. B. Wang. Virus resistance and gene silencing in plants can be induced by simultaneous expression of sense and antisense RNA Proc Natl Acad Sci U S A Nov. 10, 1998 13959-13964 95.
Ngo, H., C. Tschudi, K. Gull and E. Ullu. Double-stranded RNA induces mRNA degradation in *Trypanosoma brucei* Proc Natl Acad Sci U S A Dec. 8, 1998 14687-14692 95.
Verma, S. and F. Eckstein. Modified oligonucleotides: synthesis and strategy for users Annu Rev Biochem *No date in Pubmed* 1998 99-134 67.
Wuchty, S., W. Fontana, I. L. Hofacker and P. Schuster. Complete suboptimal folding of RNA and the stability of secondary structures Biopolymers Feb. 1999 145-165 49.

(Continued)

*Primary Examiner*—J. E. Angell
*Assistant Examiner*—Dana Shin
(74) *Attorney, Agent, or Firm*—Polsinelli Shughart PC; Teddy C. Scott, Jr.

(57) ABSTRACT

The present invention relates to a group of viral RNA regulatory genes, here identified as "viral genomic address messenger genes" or "VGAM genes", and as "genomic record" or "GR" genes. VGAM genes selectively inhibit translation of known host target genes, and are believed to represent a pervasive viral attack mechanism. GR genes encode an operon-like cluster of VGAM genes. VGAM and viral GR genes may therefore be useful in diagnosing, preventing and treating viral disease. Several nucleic acid molecules are provided respectively encoding several VGAM genes, as are vectors and probes, both comprising the nucleic acid molecules, and methods and systems for detecting VGAM genes, and for counteracting their activity.

6 Claims, 17 Drawing Sheets

OTHER PUBLICATIONS

Mathews, D. H., J. Sabina, M. Zuker and D. H. Turner. Expanded sequence dependence of thermodynamic parameters improves prediction of RNA secondary structure J Mol Biol May 21, 1999 911-940 288.

Chang, P. L. Encapsulation for somatic gene therapy Ann N Y Acad Sci Jun. 18, 1999 146-158 875.

Zhang, M. Q. Large-scale gene expression data analysis: a new challenge to computational biologists Genome Res Aug. 1999 681-688 9.

Grisaru, D., M. Sternfeld, A. Eldor, D. Glick and H. Soreq. Structural roles of acetylcholinesterase variants in biology and pathology Eur J Biochem Sep. 1999 672-686 264.

Fire, A. RNA-triggered gene silencing Trends Genet Sep. 1999 358-363 15.

Tabara, H., M. Sarkissian, W. G. Kelly, J. Fleenor, A. Grishok, L. Timmons, A. Fire and C. C. Mello. The rde-1 gene, RNA interference, and transposon silencing in C. elegans Cell Oct. 15, 1999 123-132 99.

Ryo, A., Y. Suzuki, K. Ichiyama, T. Wakatsuki, N. Kondoh, A. Hada, M. Yamamoto and N. Yamamoto. Serial analysis of gene expression in HIV-1-infected T cell lines FEBS Lett Nov. 26, 1999 182-186 462.

Olsen, P. H. and V. Ambros. The lin-4 regulatory RNA controls developmental timing in Caenorhabditis elegans by blocking LIN-14 protein synthesis after the initiation of translation Dev Biol Dec. 15, 1999 671-680 216.

Tuschl, T., P. D. Zamore, R. Lehmann, D. P. Bartel and P. A. Sharp. Targeted mRNA degradation by double-stranded RNA in vitro Genes Dev Dec. 15, 1999 3191-3197 13.

Reinhart, B. J., F. J. Slack, M. Basson, A. E. Pasquinelli, J. C. Bettinger, A. E. Rougvie, H. R. Horvitz and G. Ruvkun. The 21-nucleotide let-7 RNA regulates developmental timing in Caenorhabditis elegans Nature Feb. 24, 2000 901-906 403.

Pitt, J. N., J. A. Schisa and J. R. Priess. P granules in the germ cells of Caenorhabditis elegans adults are associated with clusters of nuclear pores and contain RNA Dev Biol Mar. 15, 2000 315-333 219.

Hammond, S. M., E. Bernstein, D. Beach and G. J. Hannon. An RNA-directed nuclease mediates post-transcriptional gene silencing in Drosophila cells Nature Mar. 16, 2000 293-296 404.

Slack, F. J., M. Basson, Z. Liu, V. Ambros, H. R. Horvitz and G. Ruvkun. The lin-41 RBCC gene acts in the C. elegans heterochronic pathway between the let-7 regulatory RNA and the LIN-29 transcription factor Mol Cell Apr. 2000 659-669 5.

Fortier, E. and J. M. Belote. Temperature-dependent gene silencing by an expressed inverted repeat in Drosophila Genesis Apr. 2000 240-244 26.

Mourrain, P., C. Beclin, T. Elmayan, F. Feuerbach, C. Godon, J. B. Morel, D. Jouette, A. M. Lacombe, S. Nikic, N. Picault, K. Remoue, M. Sanial, T. A. Vo and H. Vaucheret. Arabidopsis SGS2 and SGS3 genes are required for posttranscriptional gene silencing and natural virus resistance Cell May. 26, 2000 533-542 101.

Sijen, T. and J. M. Kooter. Post-transcriptional gene-silencing: RNAs on the attack or on the defense? Bioessays Jun. 2000 520-531 22.

Brenner, S., M. Johnson, J. Bridgham, G. Golda, D. H. Lloyd, D. Johnson, S. Luo, S. McCurdy, M. Foy, M. Ewan, R. Roth, D. George, S. Eletr, G. Albrecht, E. Vermaas, S. R. Williams, K. Moon, T. Burcham, M. Pallas, R. B. Dubridge, J. Kirchner, K. Fearon, J. Mao and K. Corcoran. Gene expression analysis by massively parallel signature sequencing (MPSS) on microbead arrays Nat Biotechnol Jun. 2000 630-634 18.

Ryo, A., Y. Suzuki, M. Arai, N. Kondoh, T. Wakatsuki, A. Hada, M. Shuda, K. Tanaka, C. Sato, M. Yamamoto and N. Yamamoto. Identification and characterization of differentially expressed mRNAs in HIV type 1-infected human T cells AIDS Res Hum Retroviruses Jul. 1, 2000 995-1005 16.

Nilsson, M., G. Barbany, D. O. Antson, K. Gertow and U. Landegren. Enhanced detection and distinction of RNA by enzymatic probe ligation Nat Biotechnol Jul. 2000 791-793 18.

Kent, W. J. and A. M. Zahler. Conservation, regulation, synteny, and introns in a large-scale C. briggsae-C. elegans genomic alignment Genome Res Aug. 2000 1115-1125 10.

Kennerdell, J. R. and R. W. Carthew. Heritable gene silencing in Drosophila using double-stranded RNA Nat Biotechnol Aug. 2000 896-898 18.

Smith, N. A., S. P. Singh, M. B. Wang, P. A. Stoutjesdijk, A. G. Green and P. M. Waterhouse. Total silencing by intron-spliced hairpin RNAs Nature Sep. 21, 2000 319-320 407.

Voinnet, O., C. Lederer and D. C. Baulcombe. A viral movement protein prevents spread of the gene silencing signal in Nicotiana benthamiana Cell Sep. 29, 2000 157-167 103.

Mette MF, Aufsatz W, van der Winden J, Matzke MA, Matzke AJ. Transcriptional silencing and promoter methylation triggered by double-stranded RNA. EMBO J. Oct. 2, 2000 5194-201 19.

Yang, D., H. Lu and J. W. Erickson. Evidence that processed small dsRNAs may mediate sequence-specific mRNA degradation during RNAi in Drosophila embryos Curr Biol Oct. 5, 2000 1191-1200 10.

Anandalakshmi, R., R. Marathe, X. Ge, J. M. Herr, Jr., C. Mau, A. Mallory, G. Pruss, L. Bowman and V. B. Vance. A calmodulin-related protein that suppresses posttranscriptional gene silencing in plants Science Oct. 6, 2000 142-144 290.

Fagard, M., S. Boutet, J. B. Morel, C. Bellini and H. Vaucheret. AGO1, QDE-2, and RDE-1 are related proteins required for post-transcriptional gene silencing in plants, quelling in fungi, and RNA interference in animals Proc Natl Acad Sci U S A Oct. 10, 2000 11650-11654 97.

Pasquinelli, A. E., B. J. Reinhart, F. Slack, M. Q. Martindale, M. I. Kuroda, B. Maller, D. C. Hayward, E. E. Ball, B. Degnan, P. Muller, J. Spring, A. Srinivasan, M. Fishman, J. Finnerty, J. Corbo, M. Levine, P. Leahy, E. Davidson and G. Ruvkun. Conservation of the sequence and temporal expression of let-7 heterochronic regulatory RNA Nature Nov. 2, 2000 86-89 408.

Llave, C., K. D. Kasschau and J. C. Carrington. Virus-encoded suppressor of posttranscriptional gene silencing targets a maintenance step in the silencing pathway Proc Natl Acad Sci U S A Nov. 21, 2000 13401-13406 9.

Cogoni, C. and G. Macino. Post-transcriptional gene silencing across kingdoms Curr Opin Genet Dev Dec. 2000 638-643 10.

Elbashir, S. M., W. Lendeckel and T. Tuschl. RNA interference is mediated by 21- and 22-nucleotide RNAs Genes Dev Jan. 15, 2001 188-200 15.

Bernstein, E., A. A. Caudy, S. M. Hammond and G. J. Hannon. Role for a bidentate ribonuclease in the initiation step of RNA interference Nature Jan. 18, 2001 363-366 409.

Vaucheret, H. and M. Fagard. Transcriptional gene silencing in plants: targets, inducers and regulators Trends Genet Jan. 2001 29-35 17.

Thomas, C. L., L. Jones, D. C. Baulcombe and A. J. Maule. Size constraints for targeting post-transcriptional gene silencing and for RNA-directed methylation in Nicotiana benthamiana using a potato virus X vector Plant J Feb. 2001 417-425 25.

Galyam, N., D. Grisaru, M. Grifman, N. Melamed-Book, F. Eckstein, S. Seidman, A. Eldor and H. Soreq. Complex host cell responses to antisense suppression of ACHE gene expression Antisense Nucleic Acid Drug Dev Feb. 2001 51-57 11.

Sharp, P. A. RNA interference—2001 Genes Dev Mar. 1, 2001 485-490 15.

Mallory, A. C., L. Ely, T. H. Smith, R. Marathe, R. Anandalakshmi, M. Fagard, H. Vaucheret, G. Pruss, L. Bowman and V. B. Vance. HC-Pro suppression of transgene silencing eliminates the small RNAs but not transgene methylation or the mobile signal Plant Cell Mar. 2001 571-583 13.

Matzke, M. A., A. J. Matzke, G. J. Pruss and V. B. Vance. RNA-based silencing strategies in plants Curr Opin Genet Dev Apr. 2001 221-227 11.

Schisa, J. A., J. N. Pitt and J. R. Priess. Analysis of RNA associated with P granules in germ cells of C. elegans adults Development Apr. 2001 1287-1298 128.

Di Serio, F., H. Schob, A. Iglesias, C. Tarina, E. Bouldoires and F. Meins, Jr. Sense- and antisense-mediated gene silencing in tobacco is inhibited by the same viral suppressors and is associated with accumulation of small RNAs Proc Natl Acad Sci U S A May 22, 2001 6506-6510 98.

Elbashir, S. M., J. Harborth, W. Lendeckel, A. Yalcin, K. Weber and T. Tuschl. Duplexes of 21-nucleotide RNAs mediate RNA interference in cultured mammalian cells Nature May 24, 2001 494-498 411.

Piccin, A., A. Salameh, C. Benna, F. Sandrelli, G. Mazzotta, M. Zordan, E. Rosato, C. P. Kyriacou and R. Costa. Efficient and heritable functional knock-out of an adult phenotype in Drosophila using a GAL4-driven hairpin RNA incorporating a heterologous spacer Nucleic Acids Res Jun. 15, 2001 E55-55 29.

Vance, V. and H. Vaucheret. RNA silencing in plants—defense and counterdefense Science Jun. 22, 2001 2277-2280 292.

Argaman, L., R. Hershberg, J. Vogel, G. Bejerano, E. G. Wagner, H. Margalit and S. Altuvia. Novel small RNA-encoding genes in the intergenic regions of *Escherichia coli* Curr Biol Jun. 26, 2001 941-950 11.

Grishok, A., A. E. Pasquinelli, D. Conte, N. Li, S. Parrish, I. Ha, D. L. Baillie, A. Fire, G. Ruvkun and C. C. Mello. Genes and mechanisms related to RNA interference regulate expression of the small temporal RNAs that control *C. elegans* developmental timing Cell Jul. 13, 2001 23-34 106.

Hutvagner, G., J. McLachlan, A. E. Pasquinelli, E. Balint, T. Tuschl and P. D. Zamore. A cellular function for the RNA-interference enzyme Dicer in the maturation of the let-7 small temporal RNA Science Aug. 3, 2001 834-838 293.

Hammond, S. M., S. Boettcher, A. A. Caudy, R. Kobayashi and G. J. Hannon. Argonaute2, a link between genetic and biochemical analyses of RNAi Science Aug. 10, 2001 1146-1150 293.

Vaucheret, H., C. Beclin and M. Fagard. Post-transcriptional gene silencing in plants J Cell Sci Sep. 2001 3083-3091 114.

Wesley, S. V., C. A. Helliwell, N. A. Smith, M. B. Wang, D. T. Rouse, Q. Liu, P. S. Gooding, S. P. Singh, D. Abbott, P. A. Stoutjesdijk, S. P. Robinson, A. P. Gleave, A. G. Green and P. M. Waterhouse. Construct design for efficient, effective and high-throughput gene silencing in plants Plant J Sep. 2001 581-590 27.

Mattick, J. S. and M. J. Gagen. The evolution of controlled multitasked gene networks: the role of introns and other noncoding RNAs in the development of complex organisms Mol Biol Evol Sep. 2001 1611-1630 18.

Carter, R. J., I. Dubchak and S. R. Holbrook. A computational approach to identify genes for functional RNAs in genomic sequences Nucleic Acids Res Oct. 1, 2001 3928-3938 29.

Moss, E. G. RNA interference: it's a small RNA world Curr Biol Oct. 2, 2001 R772-775 11.

Ketting, R. F., S. E. Fischer, E. Bernstein, T. Sijen, G. J. Hannon and R. H. Plasterk. Dicer functions in RNA interference and in synthesis of small RNA involved in developmental timing in *C. elegans* Genes Dev Oct. 15, 2001 2654-2659 15.

Ruvkun, G. Molecular biology. Glimpses of a tiny RNA world Science Oct. 26, 2001 797-799 294.

Lee, R. C. and V. Ambros. An extensive class of small RNAs in *Caenorhabditis elegans* Science Oct. 26, 2001 862-864 294.

Lau, N. C., L. P. Lim, E. G. Weinstein and D. P. Bartel. An abundant class of tiny RNAs with probable regulatory roles in *Caenorhabditis elegans* Science Oct. 26, 2001 858-862 294.

Lagos-Quintana, M., R. Rauhut, W. Lendeckel and T. Tuschl. Identification of novel genes coding for small expressed RNAs Science Oct. 26, 2001 853-858 294.

Itaya, A., A. Folimonov, Y. Matsuda, R. S. Nelson and B. Ding. Potato spindle tuber viroid as inducer of RNA silencing in infected tomato Mol Plant Microbe Interact Nov. 2001 1332-1334 14.

Mattick, J. S. Non-coding RNAs: the architects of eukaryotic complexity EMBO Rep Nov. 2001 986-991 2.

Elbashir, S. M., J. Martinez, A. Patkaniowska, W. Lendeckel and T. Tuschl. Functional anatomy of siRNAs for mediating efficient RNAi in *Drosophila melanogaster* embryo lysate Embo J Dec. 3, 2001 6877-6888 20.

Ambros, V. microRNAs: tiny regulators with great potential Cell Dec. 28, 2001 823-826 107.

Blaszczyk, J., J. E. Tropea, M. Bubunenko, K. M. Routzahn, D. S. Waugh, D. L. Court and X. Ji. Crystallographic and modeling studies of RNase III suggest a mechanism for double-stranded RNA cleavage Structure Dec. 2001 1225-1236 9.

Crete, P., S. Leuenberger, V. A. Iglesias, V. Suarez, H. Schob, H. Holtorf, S. Van Eeden and F. Meins. Graft transmission of induced and spontaneous post-transcriptional silencing of chitinase genes Plant J Dec. 2001 493-501 28.

Smallridge, R. A small fortune Nat Rev Mol Cell Biol Dec. 2001 867 2.

Eddy, S. R. Non-coding RNA genes and the modern RNA world Nat Rev Genet Dec. 2001 919-929 2.

Lu, C. M. miRNA bead detection Genaco Biomedical Products PHS 398 2001 1.

Matzke, M., A. J. Matzke and J. M. Kooter. RNA: guiding gene silencing 2001 1080 293.

Grosshans, H. and F. J. Slack. Micro-RNAs: small is plentiful J Cell Biol Jan. 7, 2002 17-21 156.

Meshorer, E., C. Erb, R. Gazit, L. Pavlovsky, D. Kaufer, A. Friedman, D. Glick, N. Ben-arie and H. Soreq. Alternative splicing and neuritic mRNA translocation under long-term neuronal hypersensitivity Science Jan. 18, 2002 508-512 295.

Paddison, P. J., A. A. Caudy and G. J. Hannon. Stable suppression of gene expression by RNAi in mammalian cells Proc Natl Acad Sci U S A Feb. 5, 2002 1443-1448 99.

Moss, E. G. MicroRNAs: hidden in the genome Curr Biol Feb. 19, 2002 R138-140 12.

Banerjee, D. and F. Slack. Control of developmental timing by small temporal RNAs: a paradigm for RNA-mediated regulation of gene expression Bioessays Feb. 2002 119-129 24.

Elbashir, S. M., J. Harborth, K. Weber and T. Tuschl. Analysis of gene function in somatic mammalian cells using small interfering RNAs Methods Feb. 2002 199-213 26.

Han, Y. and D. Grierson. Relationship between small antisense RNAs and aberrant RNAs associated with sense transgene mediated gene silencing in tomato Plant J Feb. 2002 509-519 29.

Nicholson, R. H. and A. W. Nicholson. Molecular characterization of a mouse cDNA encoding Dicer, a ribonuclease III ortholog involved in RNA interference Mamm Genome Feb. 2002 67-73 13.

Puerta-Fernandez, E., A. Barroso-Deljesus and A. Berzal-Herranz. Anchoring hairpin ribozymes to long target RNAs by loop-loop RNA interactions Antisense Nucleic Acid Drug Dev Feb. 2002 1-9 12.

Giordano, E., R. Rendina, I. Peluso and M. Furia. RNAi triggered by symmetrically transcribed transgenes in *Drosophila melanogaster* Genetics Feb. 2002 637-648 160.

Martens, H., J. Novotny, J. Oberstrass, T. L. Steck, P. Postlethwait and W. Nellen. RNAi in Dictyostelium: the role of RNA-directed RNA polymerases and double-stranded RNase Mol Biol Cell Feb. 2002 445-453 13.

Mourelatos, Z., J. Dostie, S. Paushkin, A. Sharma, B. Charroux, L. Abel, J. Rappsilber, M. Mann and G. Dreyfuss. miRNPs: a novel class of ribonucleoproteins containing numerous microRNAs Genes Dev Mar. 15, 2002 720-728 16.

Seggerson, K., L. Tang and E. G. Moss. Two genetic circuits repress the *Caenorhabditis elegans* heterochronic gene lin-28 after translation initiation Dev Biol Mar. 15, 2002 215-225 243.

Morel, J. B., C. Godon, P. Mourrain, C. Beclin, S. Boutet, F. Feuerbach, F. Proux and H. Vaucheret. Fertile hypomorphic Argonaute (ago1) mutants impaired in post-transcriptional gene silencing and virus resistance Plant Cell Mar. 2002 629-639 14.

Catalanotto, C., G. Azzalin, G. Macino and C. Cogoni. Involvement of small RNAs and role of the qde genes in the gene silencing pathway in Neurospora Genes Dev Apr. 1, 2002 790-795 16.

Boutla, A., K. Kalantidis, N. Tavernarakis, M. Tsagris and M. Tabler. Induction of RNA interference in *Caenorhabditis elegans* by RNAs derived from plants exhibiting post-transcriptional gene silencing Nucleic Acids Res Apr. 1, 2002 1688-1694 30.

Pasquinelli, A. E. and G. Ruvkun. Control of developmental timing by micrornas and their targets Annu Rev Cell Dev Biol Epub 2002 Apr. 2, 2002 495-513 18.

Paddison, P. J., A. A. Caudy, E. Bernstein, G. J. Hannon and D. S. Conklin. Short hairpin RNAs (shRNAs) induce sequence-specific silencing in mammalian cells Genes Dev Apr. 15, 2002 948-958 16.

Beclin, C., S. Boutet, P. Waterhouse and H. Vaucheret. A branched pathway for transgene-induced RNA silencing in plants Curr Biol Apr. 16, 2002 684-688 12.

Eddy, S. R. Computational genomics of noncoding RNA genes Cell Apr. 19, 2002 137-140 109.

Lagos-Quintana, M., R. Rauhut, A. Yalcin, J. Meyer, W. Lendeckel and T. Tuschl. Identification of tissue-specific microRNAs from mouse Curr Biol Apr. 30, 2002 735-739 12.

Kent, W. J. BLAT—the BLAST-like alignment tool Genome Res Apr. 2002 656-664 12.

Hutvagner, G. and P. D. Zamore. RNAi: nature abhors a double-strand Curr Opin Genet Dev Apr. 2002 225-232 12.

Nilsson, M., J. Baner, M. Mendel-Hartvig, F. Dahl, D. O. Antson, M. Gullberg and U. Landegren. Making ends meet in genetic analysis using padlock probes Hum Mutat Apr. 2002 410-415 19.

Pasquinelli, A. E. MicroRNAs: deviants no longer Trends Genet Apr. 2002 171-173 18.

Lai, E. C. Micro RNAs are complementary to 3' UTR sequence motifs that mediate negative post-transcriptional regulation Nat Genet Apr. 2002 363-364 30.

Schwarz, D. S. and P. D. Zamore. Why do miRNAs live in the miRNP? Genes Dev May. 1, 2002 1025-1031 16.

Brantl, S. Antisense-RNA regulation and RNA interference Biochim Biophys Acta May 3, 2002 15-25 1575.

Li, H., W. X. Li and S. W. Ding. Induction and suppression of RNA silencing by an animal virus Science May 17, 2002 1319-1321 296.

Zamore, P. D. Ancient pathways programmed by small RNAs Science May 17, 2002 1265-1269 296.

Chen, S., E. A. Lesnik, T. A. Hall, R. Sampath, R. H. Griffey, D. J. Ecker and L. B. Blyn. A bioinformatics based approach to discover small RNA genes in the *Escherichia coli* genome Biosystems Mar.-May 2002 157-177 65.

Lee, N. S., T. Dohjima, G. Bauer, H. Li, M. J. Li, A. Ehsani, P. Salvaterra and J. Rossi. Expression of small interfering RNAs targeted against HIV-1 rev transcripts in human cells Nat Biotechnol May 2002 500-505 20.

Draghici, S. Statistical intelligence: effective analysis of high-density microarray data Drug Discov Today Jun. 1, 2002 S55-63 7.

Silhavy, D., A. Molnar, A. Lucioli, G. Szittya, C. Hornyik, M. Tavazza and J. Burgyan. A viral protein suppresses RNA silencing and binds silencing-generated, 21- to 25-nucleotide double-stranded RNAs Embo J Jun. 17, 2002 3070-3080 21.

Ayash-Rashkovsky, M., Z. Weisman, J. Diveley, R. B. Moss, Z. Bentwich and G. Borkow. Generation of Th1 immune responses to inactivated, gp120-depleted HIV-1 in mice with a dominant Th2 biased immune profile via immunostimulatory [correction of imunostimulatory] oligonucleotides—relevance to AIDS vaccines in developing countries Vaccine Jun. 21, 2002 2684-2692 20.

Tabara, H., E. Yigit, H. Siomi and C. C. Mello. The dsRNA binding protein RDE-4 interacts with RDE-1, DCR-1, and a DExH-box helicase to direct RNAi in *C. elegans* Cell Jun. 28, 2002 861-871 109.

Bettencourt, R., O. Terenius and I. Faye. Hemolin gene silencing by ds-RNA injected into *Cecropia pupae* is lethal to next generation embryos Insect Mol Biol Jun. 2002 267-271 11.

Hooper, N. M. and A. J. Turner. The search for alpha-secretase and its potential as a therapeutic approach to Alzheimer s disease Curr Med Chem Jun. 2002 1107-1119 9.

Liu, Q., S. Singh and A. Green. High-oleic and high-stearic cottonseed oils: nutritionally improved cooking oils developed using gene silencing J Am Coll Nutr Jun. 2002 205S-211S 21.

Zeng, Y., E. J. Wagner and B. R. Cullen. Both natural and designed micro RNAs can inhibit the expression of cognate mRNAs when expressed in human cells Mol Cell Jun. 2002 1327-1333 9.

McManus, M. T., C. P. Petersen, B. B. Haines, J. Chen and P. A. Sharp. Gene silencing using micro-RNA designed hairpins Rna Jun. 2002 842-850 8.

Reinhart, B. J., E. G. Weinstein, M. W. Rhoades, B. Bartel and D. P. Bartel. MicroRNAs in plants Genes Dev Jul. 1, 2002 1616-1626 16.

McCaffrey, A. P., L. Meuse, T. T. Pham, D. S. Conklin, G. J. Hannon and M. A. Kay. RNA interference in adult mice Nature Jul. 4, 2002 38-39 418.

Hannon, G. J. RNA interference Nature Jul. 11, 2002 244-251 418.

Dennis, C. The brave new world of RNA Nature Jul. 11, 2002 122-124 418.

Jacque, J. M., K. Triques and M. Stevenson. Modulation of HIV-1 replication by RNA interference Nature Jul. 25, 2002 435-438 418.

Cullen, B. R. RNA interference: antiviral defense and genetic tool Nat Immunol Jul. 2002 597-599 3.

Ma, C. and A. Mitra. Intrinsic direct repeats generate consistent post-transcriptional gene silencing in tobacco Plant J Jul. 2002 37-49 31.

Novina, C. D., M. F. Murray, D. M. Dykxhoorn, P. J. Beresford, J. Riess, S. K. Lee, R. G. Collman, J. Lieberman, P. Shankar and P. A. Sharp. siRNA-directed inhibition of HIV-1 infection Nat Med Jul. 2002 681-686 8.

Pomerantz, R. J. RNA interference meets HIV-1: will silence be golden? Nat Med Jul. 2002 659-660 8.

Zeng, Y. and B. R. Cullen. RNA interference in human cells is restricted to the cytoplasm Rna Jul. 2002 855-860 8.

Xiang, C. C., O. A. Kozhich, M. Chen, J. M. Inman, Q. N. Phan, Y. Chen and M. J. Brownstein. Amine-modified random primers to label probes for DNA microarrays Nat Biotechnol Jul. 2002 738-742 20.

Llave, C., K. D. Kasschau, M. A. Rector and J. C. Carrington. Endogenous and silencing-associated small RNAs in plants Plant Cell Jul. 2002 1605-1619 14.

Rhoades, M. W., B. J. Reinhart, L. P. Lim, C. B. Burge, B. Bartel and D. P. Bartel. Prediction of plant microRNA targets Cell Aug. 23, 2002 513-520 110.

Hipfner, D. R., K. Weigmann and S. M. Cohen. The bantam gene regulates Drosophila growth Genetics Aug. 2002 1527-1537 161.

Liu, Q., S. P. Singh and A. G. Green. High-stearic and High-oleic cottonseed oils produced by hairpin RNA-mediated post-transcriptional gene silencing Plant Physiol Aug. 2002 1732-1743 129.

Stoutjesdijk, P. A., S. P. Singh, Q. Liu, C. J. Hurlstone, P. A. Waterhouse and A. G. Green. hpRNA-mediated targeting of the Arabidopsis FAD2 gene gives highly efficient and stable silencing Plant Physiol Aug. 2002 1723-1731 129.

Suzuma, S., S. Asari, K. Bunai, K. Yoshino, Y. Ando, H. Kakeshita, M. Fujita, K. Nakamura and K. Yamane. Identification and characterization of novel small RNAs in the aspS-yrvM intergenic region of the *Bacillus subtilis* genome Microbiology Aug. 2002 2591-2598 148.

Milligan, L., T. Forne, E. Antoine, M. Weber, B. Hemonnot, L. Dandolo, C. Brunel and. G. Cathala. Turnover of primary transcripts is a major step in the regulation of mouse H19 gene expression EMBO Rep Aug. 2002 774-779 3.

Hamilton, A., O. Voinnet, L. Chappell and D. Baulcombe. Two classes of short interfering RNA in RNA silencing Embo J Sep. 2, 2002 4671-4679 21.

Lee, Y., K. Jeon, J. T. Lee, S. Kim and V. N. Kim. MicroRNA maturation: stepwise processing and subcellular localization Embo J Sep. 2, 2002 4663-4670 21.

Klahre, U., P. Crete, S. A. Leuenberger, V. A. Iglesias and F. Meins, Jr. High molecular weight RNAs and small interfering RNAs induce systemic posttranscriptional gene silencing in plants Proc Natl Acad Sci U S A Sep. 3, 2002 11981-11986 99.

Park, W., J. Li, R. Song, J. Messing and X. Chen. Carpel Factory, a Dicer homolog, and HEN1, a novel protein, act in microRNA metabolism in *Arabidopsis thaliana* Curr Biol Sep. 3, 2002 1484-1495 12.

Jiang, M. and J. Milner. Selective silencing of viral gene expression in HPV-positive human cervical carcinoma cells treated with siRNA, a primer of RNA interference Oncogene Sep. 5, 2002 6041-6048 21.

Martinez, J., A. Patkaniowska, H. Urlaub, R. Luhrmann and T. Tuschl. Single-stranded antisense siRNAs guide target RNA cleavage in RNAi Cell Sep. 6, 2002 563-574 110.

Allshire, R. Molecular biology. RNAi and heterochromatin—a hushed-up affair Science Sep. 13, 2002 1818-1819 297.

Reinhart, B. J. and D. P. Bartel. Small RNAs correspond to centromere heterochromatic repeats Science Sep. 13, 2002 1831 297.

Volpe, T. A., C. Kidner, I. M. Hall, G. Teng, S. I. Grewal and R. A. Martienssen. Regulation of heterochromatic silencing and histone H3 lysine-9 methylation by RNAi Science Sep. 13, 2002 1833-1837 297.

Baulcombe, D. DNA events. An RNA microcosm Science Sep. 20, 2002 2002-2003 297.

Llave, C., Z. Xie, K. D. Kasschau and J. C. Carrington. Cleavage of Scarecrow-like mRNA targets directed by a class of Arabidopsis miRNA Science Sep. 20, 2002 2053-2056 297.

Mochizuki, K., N. A. Fine, T. Fujisawa and M. A. Gorovsky. Analysis of a piwi-related gene implicates small RNAs in genome rearrangement in tetrahymena Cell Sep. 20, 2002 689-699 110.

Hutvagner, G. and P. D. Zamore. A microRNA in a multiple-turnover RNAi enzyme complex Science Sep. 20, 2002 2056-2060 297.

Coburn, G. A. and B. R. Cullen. Potent and specific inhibition of human immunodeficiency virus type 1 replication by RNA interference J Virol Sep. 2002 9225-9231 76.

Caudy, A. A., M. Myers, G. J. Hannon and S. M. Hammond. Fragile X-related protein and VIG associate with the RNA interference machinery Genes Dev Oct. 1, 2002 2491-2496 16.

Ishizuka, A., M. C. Siomi and H. Siomi. A Drosophila fragile X protein interacts with components of RNAi and ribosomal proteins Genes Dev Oct. 1, 2002 2497-2508 16.

Voinnet, O. RNA silencing: small RNAs as ubiquitous regulators of gene expression Curr Opin Plant Biol Oct. 2002 444-451 5.

Golden, T. A., S. E. Schauer, J. D. Lang, S. Pien, A. R. Mushegian, U. Grossniklaus, D. W. Meinke and A. Ray. Short Integuments1/Suspensor1/Carpel Factory, a Dicer homolog, is a maternal effect gene required for embryo development in Arabidopsis Plant Physiol Oct. 2002 808-822 130.

Merkle, I., M. J. Van Ooij, F. J. Van Kuppeveld, D. H. Glaudemans, J. M. Galama, A. Henke, R. Zell and W. J. Melchers. Biological significance of a human enterovirus B-specific RNA element in the 3' nontranslated region J Virol Oct. 2002 9900-9909 76.

Froeyen, M. and P. Herdewijn. RNA as a target for drug design, the example of Tat-TAR interaction Curr Top Med Chem Oct. 2002 1123-1145 2.

Carmell, M. A., Z. Xuan, M. Q. Zhang and G. J. Hannon. The Argonaute family: tentacles that reach into RNAi, developmental control, stem cell maintenance, and tumorigenesis Genes Dev Nov. 1, 2002 2733-2742 16.

Provost, P., D. Dishart, J. Doucet, D. Frendewey, B. Samuelsson and O. Radmark. Ribonuclease activity and RNA binding of recombinant human Dicer Embo J Nov. 1, 2002 5864-5874 21.

Zhang, H., F. A. Kolb, V. Brondani, E. Billy and W. Filipowicz. Human Dicer preferentially cleaves dsRNAs at their termini without a requirement for ATP Embo J Nov. 1, 2002 5875-5885 21.

Mallory, A. C., B. J. Reinhart, D. Bartel, V. B. Vance and L. H. Bowman. A viral suppressor of RNA silencing differentially regulates the accumulation of short interfering RNAs and micro-RNAs in tobacco Proc Natl Acad Sci U S A Nov. 12, 2002 15228-15233 99.

Gottesman, S. Stealth regulation: biological circuits with small RNA switches Genes Dev Nov. 15, 2002 2829-2842 16.

Calin, G. A., C. D. Dumitru, M. Shimizu, R. Bichi, S. Zupo, E. Noch, H. Aldler, S. Rattan, M. Keating, K. Rai, L. Rassenti, T. Kipps, M. Negrini, F. Bullrich and C. M. Croce. Frequent deletions and down-regulation of micro- RNA genes miR15 and miR16 at 13q14 in chronic lymphocytic leukemia Proc Natl Acad Sci U S A Nov. 26, 2002 15524-15529 99.

Gaudilliere, B., Y. Shi and A. Bonni. RNA interference reveals a requirement for myocyte enhancer factor 2A in activity-dependent neuronal survival J Biol Chem Nov. 29, 2002 46442-46446 277.

Jones, L. Revealing micro-RNAs in plants Trends Plant Sci Nov. 2002 473-475 7.

Schauer, S. E., S. E. Jacobsen, D. W. Meinke and A. Ray. Dicer-Like1: blind men and elephants in Arabidopsis development Trends Plant Sci Nov. 2002 487-491 7.

Okazaki, Y., M. Furuno, T. Kasukawa, J. Adachi, H. Bono, S. Kondo, et al. Analysis of the mouse transcriptome based on functional annotation of 60,770 full-length cDNAs Nature Dec. 5, 2002 563-573 420.

Dennis, C. Small RNAs: the genome's guiding hand? Nature Dec. 19-26, 2002 732 420.

Uchida, N., S. Hoshino, H. Imataka, N. Sonenberg and T. Katada. A novel role of the mammalian GSPT/eRF3 associating with poly(A)-binding protein in Cap/Poly(A)-dependent translation J Biol Chem Dec. 27, 2002 50286-50292 277.

Huttenhofer, A., J. Brosius and J. P. Bachellerie. RNomics: identification and function of small, non-messenger RNAs Curr Opin Chem Biol Dec. 2002 835-843 6.

Wood, N. T. Unravelling the molecular basis of viral suppression of PTGS Trends Plant Sci 2002 384 7.

Cohen, O., C. Erb, D. Ginzberg, Y. Pollak, S. Seidman, S. Shoham, R. Yirmiya and H. Soreq. Neuronal overexpression of "readthrough" acetylcholinesterase is associated with antisense-suppressible behavioral impairments Mol Psychiatry *No date in pubmed* 2002 874-885 7.

Mlotshwa, S., O. Voinnet, M. F. Mette, M. Matzke, H. Vaucheret, S. W. Ding, G. Pruss and V. B. Vance. RNA silencing and the mobile silencing signal Plant Cell *No date in pubmed* 2002 S289-301 14 Suppl.

Tang, G., B. J. Reinhart, D. P. Bartel and P. D. Zamore. A biochemical framework for RNA silencing in plants Genes Dev Jan. 1, 2003 49-63 17.

Kawasaki, H. and K. Taira. Short hairpin type of dsRNAs that are controlled by tRNA(Val) promoter significantly induce RNAi-mediated gene silencing in the cytoplasm of human cells Nucleic Acids Res Jan. 15, 2003 700-707 31.

Ashrafi, K., F. Y. Chang, J. L. Watts, A. G. Fraser, R. S. Kamath, J. Ahringer and G. Ruvkun. Genome-wide RNAi analysis of Caenorhabditis elegans fat regulatory genes Nature Jan. 16, 2003 268-272 421.

Kamath, R. S., A. G. Fraser, Y. Dong, G. Poulin, R. Durbin, M. Gotta, A. Kanapin, N. Le Bot, S. Moreno, M. Sohrmann, D. P. Welchman, P. Zipperlen and J. Ahringer. Systematic functional analysis of the Caenorhabditis elegans genome using RNAi Nature Jan. 16, 2003 231-237 421.

Tuschl, T. Functional genomics: RNA sets the standard Nature Jan. 16, 2003 220-221 421.

Shi, Y. Mammalian RNAi for the masses Trends Genet Jan. 2003 9-12 19.

Cerutti, H. RNA interference: traveling in the cell and gaining functions? Trends Genet Jan. 2003 39-46 19.

Zeng, Y. and B. R. Cullen. Sequence requirements for micro RNA processing and function in human cells RNA Jan. 2003 112-123 9.

Stein, T. D. and J. A. Johnson. Genetic programming by the proteolytic fragments of the amyloid precursor protein: somewhere between confusion and clarity Rev Neurosci *no date in pubmed* 2003 317-341 14.

Szymanski, M., M. Z. Barciszewska, M. Zywicki and J. Barciszewski. Noncoding RNA transcripts J Appl Genet *No Datein Pubmed* 2003 1-19 44.

Andresen BS, et al. Isolated 2-methylbutyrylglycinuria caused by short/branched-chain acyl-CoA dehydrogenase deficiency: identification of a new enzyme defect, resolution of its molecular basis, and evidence for distinct acyl-CoA dehydrogenases in isoleucine and valine metabolism. Am J Hum Genet. Nov. 2000;67(5):1095-103. Epub Sep. 29, 2000.

Brown CW, et al. Insertion of Inhbb into the Inhba locus rescues the Inhba-null phenotype and reveals new activin functions. Nat Genet. Aug. 2000;25(4):453-70.

Shin MS, et al. Inactivating mutations of CASP10 gene in non-Hodgkin lymphomas. Blood. Jun. 1, 2002;99(11):4094-9.

Doench JG and Sharp PA. Genes Dev, 2004;18(5):504-11.

Rozen. Genomics 1994;24:280-7.

Brown. Medical Endocrinology 2003;17(12):2404-17.

Lai EC. Nature Genetics 2002;30:363-4.

Stark A. PLoS Biology 2003;1(3):397-409.

Lai EC. Genome Biology 2004;5:115.

Vella MC. Chemistry & Biology 2004;11:1619-23.

Brennecke J. PLoS Biology 2005;3(3):e85.

Lewis BP. Cell 2003;115:787-98.

Enright AJ. Genome Biology 2003;5:R1.

Tommerup. Genomics 1995;27(2):259-64.

* cited by examiner

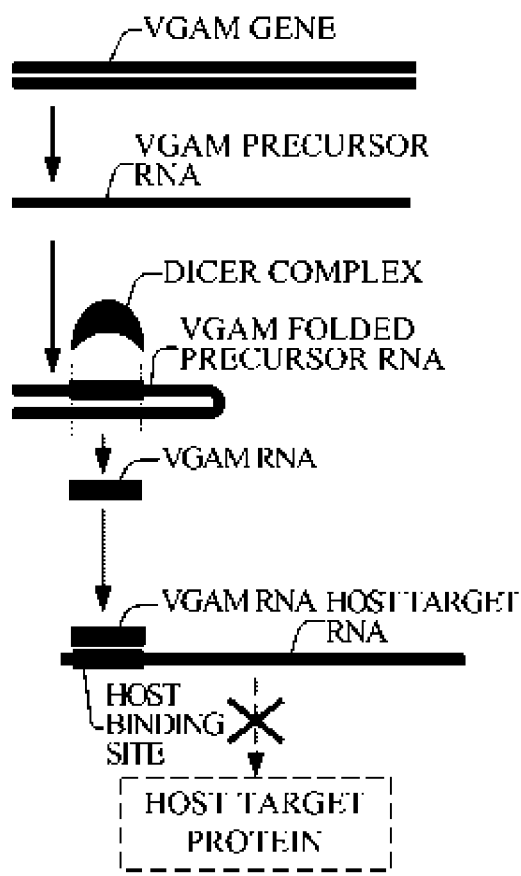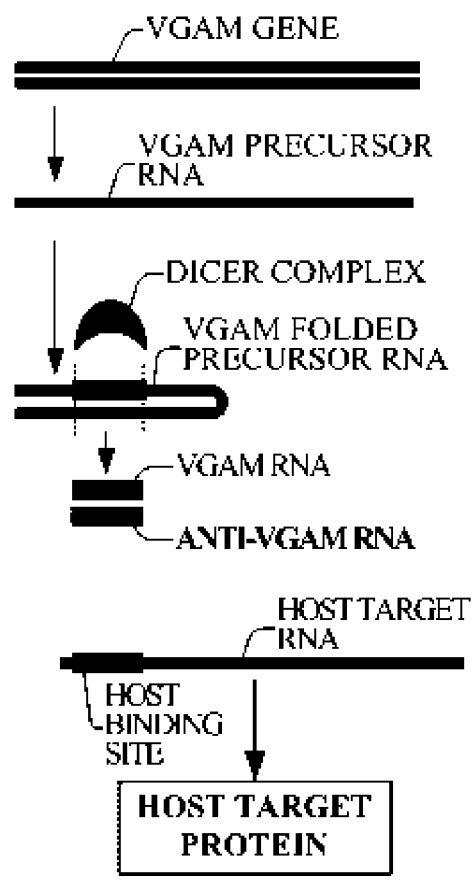
FIG. 11A
FIG. 11B

FIG. 12A

EST72223 sequence:
CCCTTATTAGAGGATTCTGCTCATGCCAGGG<u>GTGAGGTAGTAAGTTGT
ATTGTTGTGGGGTAGGGATATTAGGCCCCAATTAGAAGATAACTAT
ACAACTTACTACTTTCCC</u>TGGTGTGTGGCATATTCACACTTAGTCTTA  MIR98
GCAGTGTTGCCTCCATCAGACAAAGTTGTAGATGTTCCTTGGATAATT
TGGACTGGAAGAAAAGAGACATGGAAGGGGACAGATGGTGTTTAGG
GTGAGGCAGATGTCATTATAAAGTGACTTGTCTTTCATTAATTGGAGC
ATATAATTATTTTACCTTTGGGCATGAACTCATTTTGCTATTCTTCAAC
TGTGTAATGATTGCATTTTATTAGTAATAGAACAGGAATGTGTGCAAG
GGAATGGAAAGCATACTTTAAGAATTTTGGGCCAGGCGCGGTGGTTC
ATGCCTGTAATCCCAGCATTTTTGGGAGGCCGAGGCGGGTGGATCA
CCTGAGGTCAGGAGTTCGAGACCAACCTGGCCAACACGGCGAAACC
CCGCCTCTACTCAAATACAAAAATTAGCCAGGCTTGGTGACACTCGC
CTGTGGTCCCAGCTACTCAGGAGGCTGAGGCAGGAGAATTGCTTGA
ACCCAGGAAGTGGAGGCTTCAGTGAGCTGAGAACACGCCACTGCA  GAM24
CTCCAGTCCTGGGCAACAGAGCAAGACTCTGTCTCAGGAAAAAAAA
AG

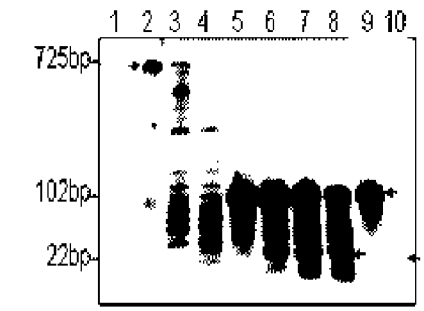

FIG. 12B

MIR98

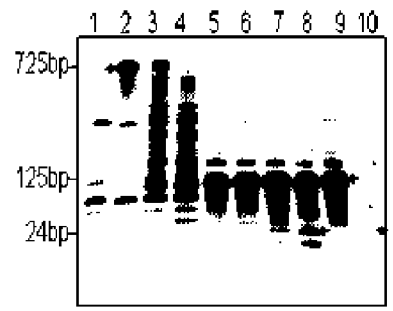

FIG. 12C

GAM24

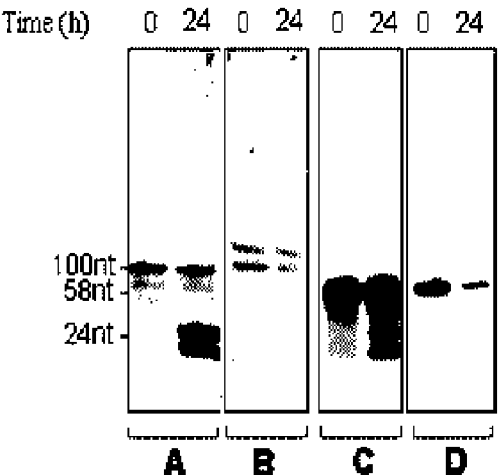

```
dbEST Id.7929020(Image4514344) sequence:
GCAAAAACTGGAAGCATTCCCTTTGAAAACTGGCACAAGACAGGGATGCCCTCT
CTCACCGCTCCTATTCAACATAGTGTTGGAAGTTCTGGCCACGGCAATTAGGCA
GGAGAAGGAAATAAAGGGTATTCAATTAGGAAAAGAGCAAGTCAAATTGTTCCT
GTTTGCAGATGACATGATTGTATATCTAGAAAACCCCATTGTCTCAGCCCCAAA
TCTCCTTAACCTGATAAGCAACTTCACCAAAGTCTCAGGATACAAAATAAATGT
ACAAAAATCACAAGCATTCTTACACACCAACAACAGAAAAACAGAGCCAAATCA
TGAGTGAACTCCCATTCACAATTGCTTCAAAGAGAATAAAATACCTAGGAATCC
AACTTACAAGGCATGTGAAGGACCTCTTCAAGGAGAACTACAAACCACTGCTCA
AGGAAATAAAAGAGGATACAAACAAATGGAAGAACATTCCATGCTCATGGGTAG
GAAGAATCAATATTGTGAAAATGGCCATACTGCCCAAGGTAATTTACAGATTCA
ATGCCATGCCCATCAAGCTACCAATGACTTTCTTCACACAATTGGAAAAAACTA
CTTTAAAGTTCATATGGAACCAAAAAAGAGCCCGCATCGCCAAGTCAATCCTAA
GCCAAAAGAACAAAGCTGGAGGCATCACACTACCTGACTTCAAACTTTTACTACA  GAM23
AGGCTACAGTAACCAAAACAGGATGGTACTGGTACCAAAACAGACATATAGATC
AATGGAACAGAACAGAGCCCTCAGAAATAACGCCGAATACCTACAACTATCTGA
TCTTTGACAAACCTGAGAAAACAAGCAATGGGGAAGGATTCCCTATTTAATA
AATGGTGCTGGCAAAACTGACTAGCCATATGTAGAAAGCTGAAACTGGATCCCT
TCCTTACACCTTATACAAAAATCAATTCAAGATGGATTAAAGATTTAAACGTTA
GACCTAAAACCATAAAAACCCTAGAAGAAAACCTAGGCATTACCATTCAGGACA
TAGCCATGGGCAAGGACTTCATGTCCAAAACACCAAAAGCAATGGCAACAAAAG
ACAAAATTGACAAATGGGATCTAATTAAACTAAAGAGCTTCTGCACAGCAAAAG
AAACTACCATCAGAGTGAACAGGCAACCTACAAAATGGGAGAAAATTTTCGCAA  GAM2
CCTACTCATCTGACAAAGGGCTAATATCCAGAATCTACAATGAACTCAAACAAA        5
TTTACAAAAAAAAAAAAAAAA
```

FIG. 13B

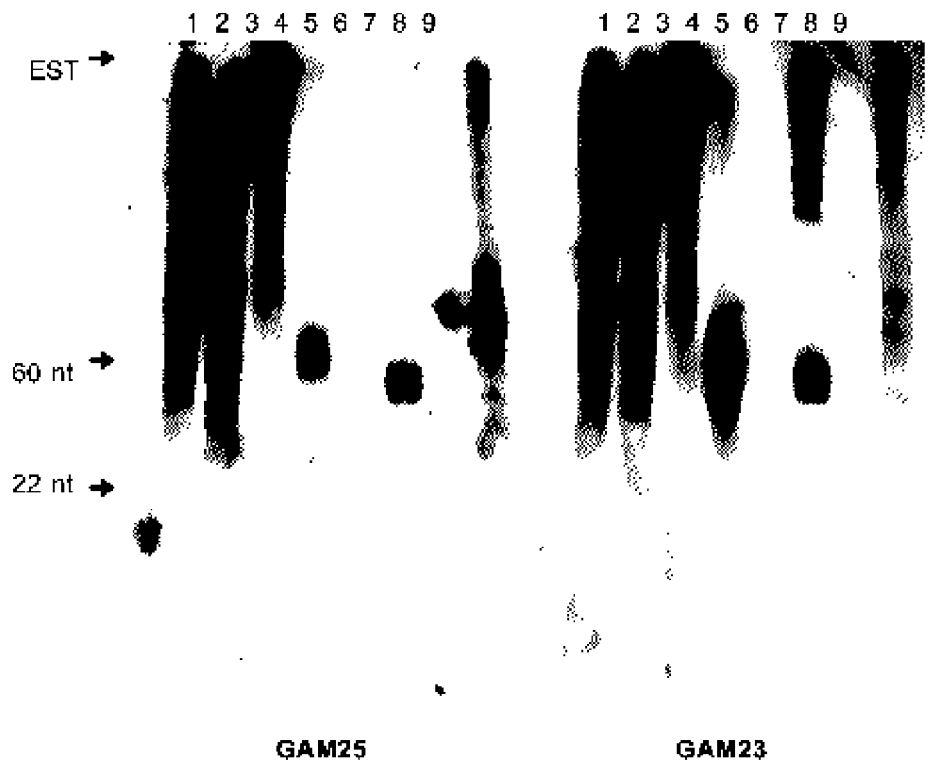

GAM25              GAM23

GAM25

FIG. 14A dbEST Id.1388749 (Image1020185) Sequence:
ACTCCTATCAACAGTGTAAAAGCATTCCTGTTTCTCCATAATCTTGCCAGCATCTT
TTCATTTTTTGAATTATAGCCATTCTGACTGTTGTGAGATGCTGTCTCATTGTGG
TTTTGATTTGCATTTCTCAGATGATCAGTGATGTTGAAGTTTTTTTGTTTGTTGGC
TGCATGTATGCCTTCTTTTGAAAAGTGTCTGTTTGTGTCCTTTGACCACTTTCTAA
TGGGGTTGAGTTTTTTTTTCTTGTAAATTTGTTTAAGTTCCTTGTAGATGCTGGAT
ATTAGACCTTTGTCAGATGGATAGAGTGCAAAAATTTTCTCCCATTCTGTAGGTTG
TCGGTTTACTCTGTTGATAGGTTCTTAATGCTGTGCAGAAGCTCTTTAGTTTAATT
AGATCCCATTTGTCAATTTTGGCTTTTGTTGCAATTGCTTTTGGCATCTTCGTCAT
GAAATCTTTGCCCTTGCCTGTGTCCTGAATGGCATTGCCTAGGTTTTCTTCCAGGA
TTTTTATAGTTTTGGGTTGTAGATTTAAGTCTTTAATCCATCTTGAGTTAACTTTT
GTATATGGCTTAAGGAAGGGGCCCGTTTCAATTTGCTGCAAATGGCTAGCCAGTTC
TCCCAGCACCATTTATTAAATAGGGAATCTTTTCCCCATTGCTTCCTTTTGTCAGG
TTTGTCAAAGATCACATGGTTGTAGGTGTGTGGTCTTATTTCTGGGTTCTCTATTC
TGTTCCATTGGGCTATGGGCCGGTTCTGTACCACCACTATGCTGTTTGGGTACCA
TAGTCTTGTAGAATGTTTGAAGCTGGGTAGCATGATGCCTCTAGCTTTGCTCTTCT
TGCTAAGAAATGTCTTGGCTATTTGGGCTCTTTTTTGGTTCCATATGAATTTTAAA
ATAGCTTTTTCTAGGTCTGTAAAGAATGTGAATAGTAGTTTAATGGGCCTAGCATT
TAATTTACAGATTGCCTTGGGCAGTGTGGTCATTTTCACGATATTGATCCTTCCTG
TCTGTGAGCATATGTTTTCCATTTGTTTGTGTCATCTCTGATTTCTTTGAATAAT    GAM
GGTTTATAGTTATCCTTGAAAAGGTCCTTCACTTTTCTTGTTAGCTGTATTCCTAG    26
ATATTATACTCTTCTTGTGGCAATTGTGAATGGGAGTTAATTCATGAGTTTTCTCT
CGGCTTGCCTGTTGTTGGTGTATAGGAATGCTAGTGACTTTTGCACATTGATTTTG
TATCCTGACACTTTGTTGAAGTTGCTTATCAGCTAAGAAGTTTTTGAGCTGAGATG
ATGGAGTTTTCTAGATATAGGATCATATCATCTGCAAACAAAGATAGTTTGACTTG
CTGTCTTCCTATTTGAATAGCTTTTCTTTCTTTCTTGCCTGATTGCCTTGGTGA
GAATTTCTAATAGTGTGTTGAATAGGAGTGGTGAGCTGGTGGGAA

FIG. 14B

GAM26

VACCINIA VIRUS-RELATED NUCLEIC ACIDS AND MICRORNA

BACKGROUND OF INVENTION

1. Field of the Invention

The present invention relates to a group of bioinformatically detectable novel viral RNA regulatory genes, here identified as "viral genomic address messenger" or "VGAM" genes.

2. Description of Prior Art

Small RNAs are known to perform diverse cellular functions, including post-transcriptional gene expression regulation. The first two such RNA genes, Lin-4 and Let-7, were identified by genetic analysis of *Caenorhabditis Elegans* (*Elegans*) developmental timing, and were termed short temporal RNA (stRNA) (Wightman, B., Ha, I., Ruvkun, G., Cell 75, 855 (1993); Erdmann, V. A. et al., Nucleic Acids Res. 29, 189 (2001); Lee, R. C., Feinbaum, R. L., Ambros, V., Cell 75, 843 (1993); Reinhart, B. et al., Nature 403, 901 (2000)).

Lin-4 and Let-7 each transcribe a ~22 nucleotide (nt) RNA, which acts a post transcriptional repressor of target mRNAs, by binding to elements in the 3"-untranslated region (UTR) of these target mRNAs, which are complimentary to the 22 nt sequence of Lin-4 and Let-7 respectively. While Lin-4 and Let-7 are expressed at different developmental stage, first larval stage and fourth larval stage respectively, both specify the temporal progression of cell fates, by triggering post-transcriptional control over other genes (Wightman, B., Ha, I., Ruvkun, G., Cell 75, 855 (1993); Slack et al., Mol. Cell 5, 659 (2000)). Let-7 as well as its temporal regulation have been demonstrated to be conserved in all major groups of bilaterally symmetrical animals, from nematodes, through flies to humans (Pasquinelli, A., et al. Nature 408, 86 (2000)).

The initial transcription product of Lin-4 and Let-7 is a ~60-80 nt RNA, the nucleotide sequence of the first half of which is partially complimentary to that of its second half, therefore allowing this RNA to fold onto itself, forming a "hairpin structure". The final gene product is a ~22 nt RNA, which is "diced" from the above mentioned "hairpin structure", by an enzyme called Dicer, which also apparently also mediates the complimentary binding of this ~22 nt segment to a binding site in the 3" UTR of its target gene.

Recent studies have uncovered 93 new genes in this class, now referred to as micro RNA or miRNA genes, in genomes of *Elegans, Drosophilea*, and Human (Lagos-Quintana, M., Rauhut, R., Lendeckel, W., Tuschl, T., Science 294, 853 (2001); Lau, N. C., Lim, L. P., Weinstein, E. G., Bartel, D. P., Science 294, 858 (2001); Lee, R. C., Ambros, V., Science 294, 862 (2001). Like the well studied Lin-4 and Let-7, all newly found MIR genes produce a ~60-80 nt RNA having a nucleotide sequence capable of forming a "hairpin structure". Expressions of the precursor ~60-80 nt RNA and of the resulting diced ~22 nt RNA of most of these newly discovered MIR genes have been detected.

Based on the striking homology of the newly discovered MIR genes to their well-studied predecessors Lin-4 and Let-7, the new MIR genes are believed to have a similar basic function as that of Lin-4 and Let-7: modulation of target genes by complimentary binding to the UTR of these target genes, with special emphasis on modulation of developmental control processes. This is despite the fact that the above mentioned recent studies did not find target genes to which the newly discovered MIR genes complementarily bind. While existing evidence suggests that the number of regulatory RNA genes "may turn out to be very large, numbering in the hundreds or even thousands in each genome", detecting such genes is challenging (Ruvkun G., "Perspective: Glimpses of a tiny RNA world", Science 294, 779 (2001)).

The ability to detect novel RNA genes is limited by the methodologies used to detect such genes. All RNA genes identified so far either present a visibly discernable whole body phenotype, as do Lin-4 and Let-7 (Wightman et. al., Cell 75, 855 (1993); Reinhart et al., Nature 403, 901 (2000)), or produce significant enough quantities of RNA so as to be detected by the standard biochemical genomic techniques, as do the 93 recently detected miRNA genes. Since a limited number clones were sequenced by the researchers discovering these genes, 300 by Bartel and 100 by Tuschl (Bartel et. al., Science 294, 858 (2001); Tuschl et. al., Science 294, 853 (2001)), the RNA genes found can not be much rarer than 1% of all RNA genes. The recently detected miRNA genes therefore represent the more prevalent among the miRNA gene family.

Current methodology has therefore been unable to detect RNA genes which either do not present a visually discernable whole body phenotype, or are rare (e.g. rarer than 0.1% of all RNA genes), and therefore do not produce significant enough quantities of RNA so as to be detected by standard biochemical technique. To date, miRNA have not been detected in viruses.

SUMMARY OF INVENTION

The present invention relates to a novel group of bioinformatically detectable, viral regulatory RNA genes, which repress expression of host target host genes, by means of complementary hybridization to binding sites in untranslated regions of these host target host genes. It is believed that this novel group of viral genes represent a pervasive viral mechanism of attacking hosts, and that therefore knowledge of this novel group of viral genes may be useful in preventing and treating viral diseases.

In various preferred embodiments, the present invention seeks to provide improved method and system for detection and prevention of viral disease, which is mediated by this group of novel viral genes.

Accordingly, the invention provides several substantially pure nucleic acids (e.g., genomic nucleic acid, cDNA or synthetic nucleic acid) each encoding a novel viral gene of the VGAM group of gene, vectors comprising the nucleic acids, probes comprising the nucleic acids, a method and system for selectively modulating translation of known "target" genes utilizing the vectors, and a method and system for detecting expression of known "target" genes utilizing the probe.

By "substantially pure nucleic acid" is meant nucleic acid that is free of the genes which, in the naturally-occurring genome of the organism from which the nucleic acid of the invention is derived, flank the genes discovered and isolated by the present invention. The term therefore includes, for example, a recombinant nucleic acid which is incorporated into a vector, into an autonomously replicating plasmid or virus, or into the genomic nucleic acid of a prokaryote or eukaryote at a site other than its natural site; or which exists as a separate molecule (e.g., a cDNA or a genomic or cDNA fragment produced by PCR or restriction endonuclease digestion) independent of other sequences. It also includes a recombinant nucleic acid which is part of a hybrid gene encoding additional polypeptide sequence.

"Inhibiting translation" is defined as the ability to prevent synthesis of a specific protein encoded by a respective gene, by means of inhibiting the translation of the mRNA of this gene. "Translation inhibiter site" is defined as the minimal nucleic acid sequence sufficient to inhibit translation.

There is thus provided in accordance with a preferred embodiment of the present invention a bioinformatically detectable novel viral gene encoding substantially pure nucleic acid wherein: RNA encoded by the bioinformatically detectable novel viral gene is about 18 to about 24 nucleotides in length, and originates from an RNA precursor, which RNA precursor is about 50 to about 120 nucleotides in length, a nucleotide sequence of a first half of the RNA precursor is a partial inversed-reversed sequence of a nucleotide sequence of a second half thereof, a nucleotide sequence of the RNA encoded by the novel viral gene is a partial inversed-reversed sequence of a nucleotide sequence of a binding site associated with at least one host target gene, and a function of the novel viral gene is bioinformatically deducible.

There is further provided in accordance with another preferred embodiment of the present invention a method for anti-viral treatment comprising neutralizing said RNA.

Further in accordance with a preferred embodiment of the present invention the neutralizing comprises: synthesizing a complementary nucleic acid molecule, a nucleic sequence of which complementary nucleic acid molecule is a partial inversed-reversed sequence of said RNA, and transfecting host cells with the complementary nucleic acid molecule, thereby complementarily binding said RNA.

Further in accordance with a preferred embodiment of the present invention the neutralizing comprises immunologically neutralizing.

There is still further provided in accordance with another preferred embodiment of the present invention a bioinformatically detectable novel viral gene encoding substantially pure nucleic acid wherein: RNA encoded by the bioinformatically detectable novel viral gene includes a plurality of RNA sections, each of the RNA sections being about 50 to about 120 nucleotides in length, and including an RNA segment, which RNA segment is about 18 to about 24 nucleotides in length, a nucleotide sequence of a first half of each of the RNA sections encoded by the novel viral gene is a partial inversed-reversed sequence of nucleotide sequence of a second half thereof, a nucleotide sequence of each of the RNA segments encoded by the novel viral gene is a partial inversed-reversed sequence of the nucleotide sequence of a binding site associated with at least one target host gene, and a function of the novel viral gene is bioinformatically deducible from the following data elements: the nucleotide sequence of the RNA encoded by the novel viral gene, a nucleotide sequence of the at least one target host gene, and function of the at least one target host gene.

Further in accordance with a preferred embodiment of the present invention the function of the novel viral gene is bioinformatically deducible from the following data elements: the nucleotide sequence of the RNA encoded by the bioinformatically detectable novel viral gene, a nucleotide sequence of the at least one target host gene, and a function of the at least one target host gene.

Still further in accordance with a preferred embodiment of the present invention the RNA encoded by the novel viral gene complementarily binds the binding site associated with the at least one target host gene, thereby modulating expression of the at least one target host gene.

Additionally in accordance with a preferred embodiment of the present invention the binding site associated with at least one target host gene is located in an untranslated region of RNA encoded by the at least one target host gene.

Moreover in accordance with a preferred embodiment of the present invention the function of the novel viral gene is selective inhibition of translation of the at least one target host gene, which selective inhibition includes complementary hybridization of the RNA encoded by the novel viral gene to the binding site.

Further in accordance with a preferred embodiment of the present invention the invention includes a vector including the DNA.

Still further in accordance with a preferred embodiment of the present invention the invention includes a method of selectively inhibiting translation of at least one gene, including introducing the vector.

Moreover in accordance with a preferred embodiment of the present invention the introducing includes utilizing RNAi pathway.

Additionally in accordance with a preferred embodiment of the present invention the invention includes a gene expression inhibition system including: the vector, and a vector inserter, functional to insert the vector into a cell, thereby selectively inhibiting translation of at least one gene.

Further in accordance with a preferred embodiment of the present invention the invention includes a probe including the DNA.

Still further in accordance with a preferred embodiment of the present invention the invention includes a method of selectively detecting expression of at least one gene, including using the probe.

Additionally in accordance with a preferred embodiment of the present invention the invention includes a gene expression detection system including: the probe, and a gene expression detector functional to selectively detect expression of at least one gene.

Further in accordance with a preferred embodiment of the present invention the invention includes an anti-viral substance capable of neutralizing the RNA.

Still further in accordance with a preferred embodiment of the present invention the neutralizing includes complementarily binding the RNA.

Additionally in accordance with a preferred embodiment of the present invention the neutralizing includes immunologically neutralizing.

Moreover in accordance with a preferred embodiment of the present invention the invention includes a method for anti-viral treatment including neutralizing the RNA.

Further in accordance with a preferred embodiment of the present invention the neutralizing includes: synthesizing a complementary nucleic acid molecule, a nucleic sequence of which complementary nucleic acid molecule is a partial inversed-reversed sequence of the RNA, and transfecting host cells with the complementary nucleic acid molecule, thereby complementarily binding the RNA.

Still further in accordance with a preferred embodiment of the present invention the neutralizing includes immunologically neutralizing.

BRIEF DESCRIPTION OF DRAWINGS

FIGS. 11A and 11B are simplified diagrams, which when taken together illustrate a mode of gene therapy applicable to genes of the novel group of genes of the present invention;

FIG. 12A is an annotated sequence of EST72223 comprising novel gene GAM24 detected by the gene detection system of the present invention;

FIGS. 12B and 12C are pictures of laboratory results, which when taken together demonstrate laboratory confirmation of expression of the bioinformatically detected novel gene GAM24 of FIG. 12A;

FIG. 12D provides pictures of laboratory results, which when taken together demonstrate further laboratory confirmation of expression of the bioinformatically detected novel gene GAM24 of FIG. 12A;

FIG. 13A is an annotated sequence of an EST7929020 comprising novel genes GAM23 and GAM25 detected by the gene detection system of the present invention;

FIG. 13B is a picture of laboratory results, which confirm expression of bioinformatically detected novel genes GAM23 and GAM25 of FIG. 13A;

FIG. 14A is an annotated sequence of an EST1388749 comprising novel gene GAM26 detected by the gene detection system of the present invention;

FIG. 14B is a picture of laboratory results, which confirm expression of the bioinformatically detected novel gene GAM26 of FIG. 14A;

BRIEF DESCRIPTION OF SEQUENCES

A Sequence Listing of genomic sequences of the present invention designated SEQ ID:1 through SEQ ID:3750 is attached to this application, enclosed in computer readable form on CD-ROM. The genomic listing comprises the following nucleotide sequences: Genomic sequences designated SEQ ID:1 through SEQ ID:363 are nucleotide sequences of 363 gene precursors of respective novel genes of the present invention; Genomic sequences designated SEQ ID:364 through SEQ ID:726 are nucleotide sequences of 363 genes of the present invention; and Genomic sequences designated SEQ ID:727 through SEQ ID:3570 are nucleotide sequences of 3025 gene precursors of respective novel genes of the present invention.

DETAILED DESCRIPTION

Figure 1:
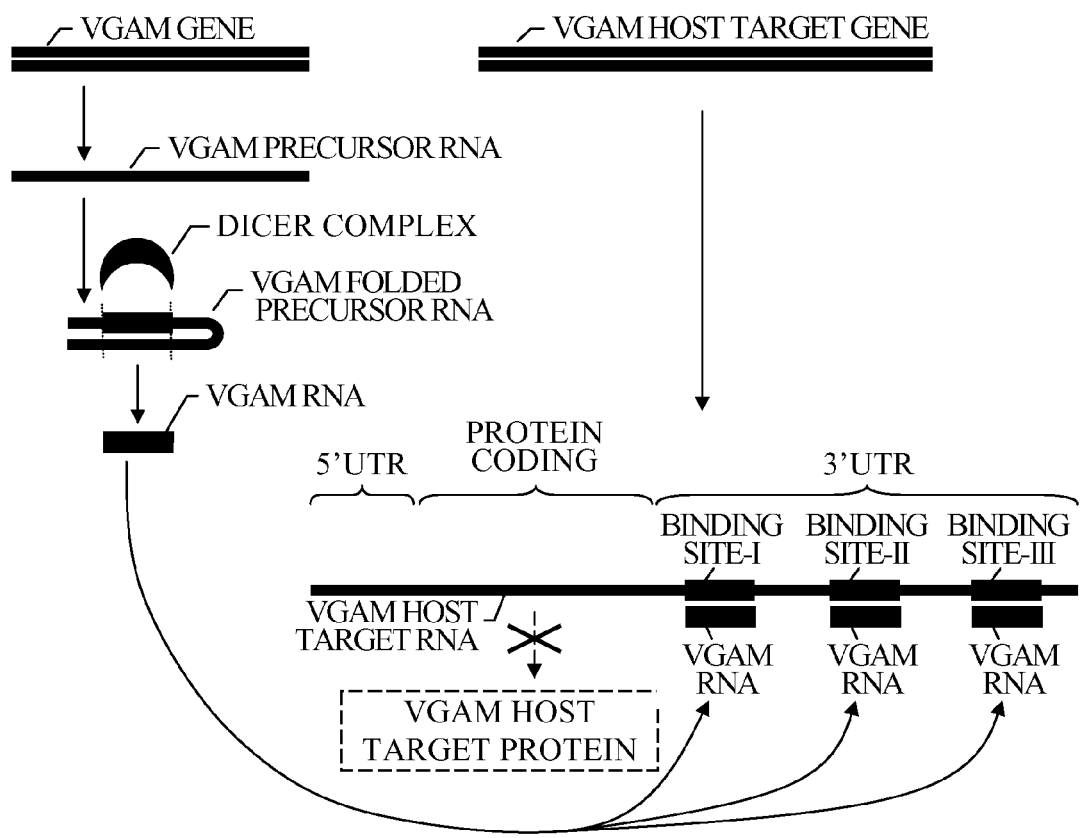
FIG. 1 is a simplified diagram illustrating a mode by which viral genes of a novel group of viral genes of the present invention, modulate expression of known host target genes.

Reference is now made to FIG. 1 which is a simplified diagram illustrating a mode by which genes of a novel group of genes of the present invention, modulate expression of known host target.

The novel genes of the present invention are micro RNA (miRNA)-like, regulatory RNA genes, modulating expression of known host target. This mode of modulation is common to other known miRNA genes, as described hereinabove with reference to the background of the invention section.

VGAM GENE and TARGET GENE are two human genes contained in the DNA of the human genome.

VGAM GENE encodes a VGAM PRECURSOR RNA. However, similar to other miRNA genes, and unlike most ordinary genes, its RNA, VGAM PRECURSOR RNA, does not encode a protein.

Figure 8:
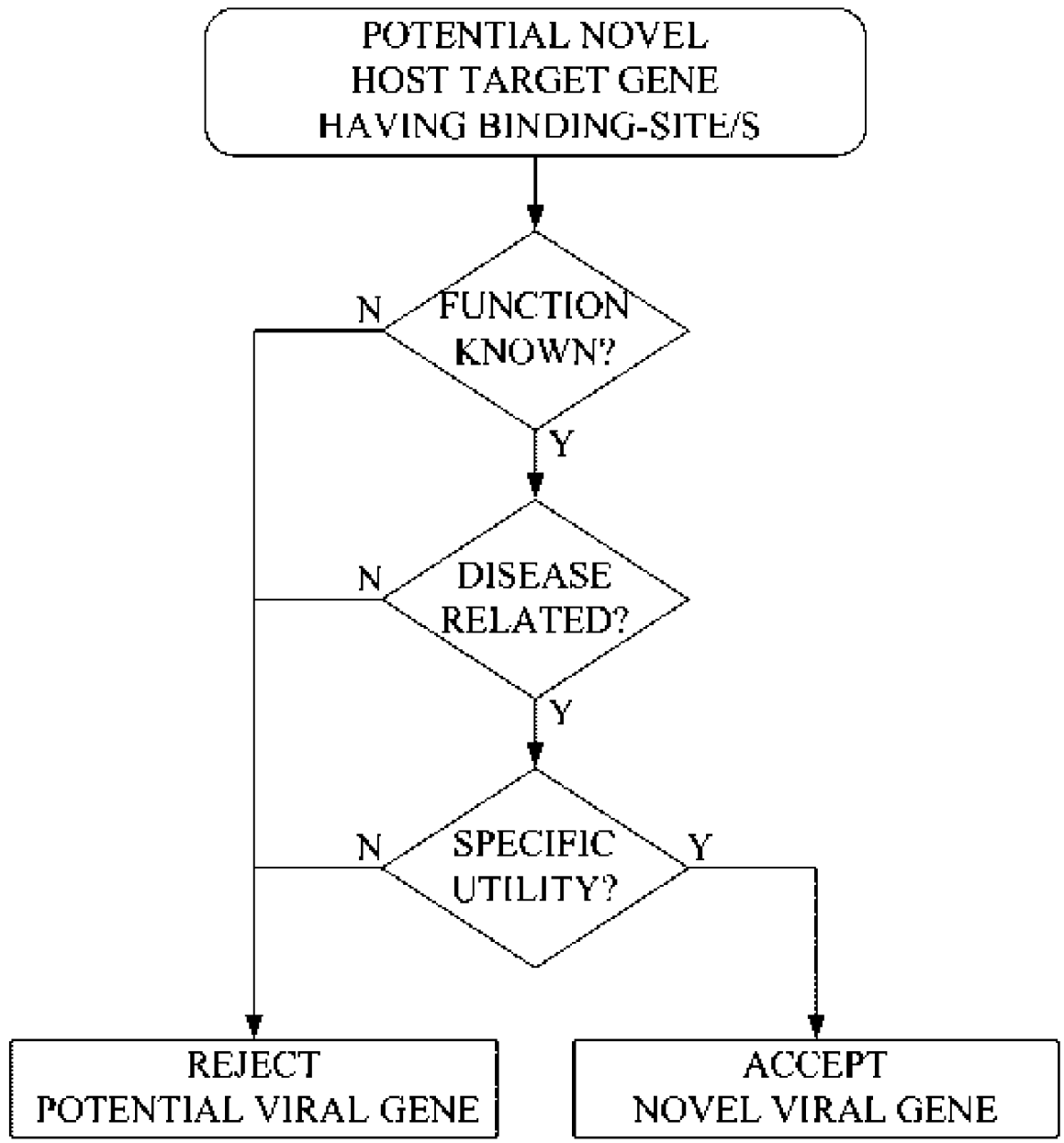
FIG. 8 is a simplified flowchart illustrating operation of a function & utility analyzer constructed and operative in accordance with a preferred embodiment of the present invention.

VGAM PRECURSOR RNA folds onto itself, forming VGAM FOLDED PRECURSOR RNA. As FIG. 8 illustrates, VGAM FOLDED PRECURSOR RNA forms a "hairpin structure", folding onto itself. As is well known in the art, this "hairpin structure", is typical genes of the miRNA genes, and is due to the fact that nucleotide sequence of the first half of the RNA of a gene in this group is an accurate or partial inversed-reversed sequence of the nucleotide sequence of its second half. By "inversed-reversed" is meant a sequence which is reversed and wherein each nucleotide is replaced by a complimentary nucleotide, as is well known in the art (e.g. ATGGC is the inversed-reversed sequence of GCCAT).

An enzyme complex, designated DICER COMPLEX, "dices" the VGAM FOLDED PRECURSOR RNA into a single stranded RNA segment, about 22 nucleotides long, designated VGAM RNA. As is known in the art, "dicing" of the hairpin structured RNA precursor into shorter RNA segments about 22 nucleotides long by a Dicer type enzyme is catalyzed by an enzyme complex comprising an enzyme called Dicer together with other necessary proteins.

TARGET GENE encodes a corresponding messenger RNA, designated TARGET RNA. This TARGET RNA comprises 3 regions: a 5" untranslated region, a protein coding region and a 3" untranslated region, designated 5"UTR, PROTEIN CODING and 3"UTR respectively.

VGAM RNA binds complementarily a BINDING SITE, located on the 3"UTR segment of TARGET RNA. This complementarily binding is due to the fact that the nucleotide sequence of VGAM RNA is an accurate or partial inversed-reversed sequence of the nucleotide sequence of BINDING SITE.

The complimentary binding of VGAM RNA to BINDING SITE inhibits translation of TARGET RNA into TARGET PROTEIN. TARGET PROTEIN is therefore outlined by a broken line.

It is appreciated by one skilled in the art that the mode of transcriptional inhibition illustrated by FIG. 1 with specific reference to VGAM genes of the present invention, is in fact common to all other miRNA genes. A specific complimentary binding site has been demonstrated only for Lin-4 and Let-7. All the other 93 newly discovered miRNA genes are also believed by those skilled in the art to modulate expression of other genes by complimentary binding, although specific complimentary binding sites for these genes have not yet been found (Ruvkun G., "Perspective: Glimpses of a tiny RNA world", Science 294, 779 (2001)). The present invention discloses a novel group of genes, the VGAM genes, belonging to the miRNA genes group, and for which a specific an complimentary binding has been determined.

Figure 2:
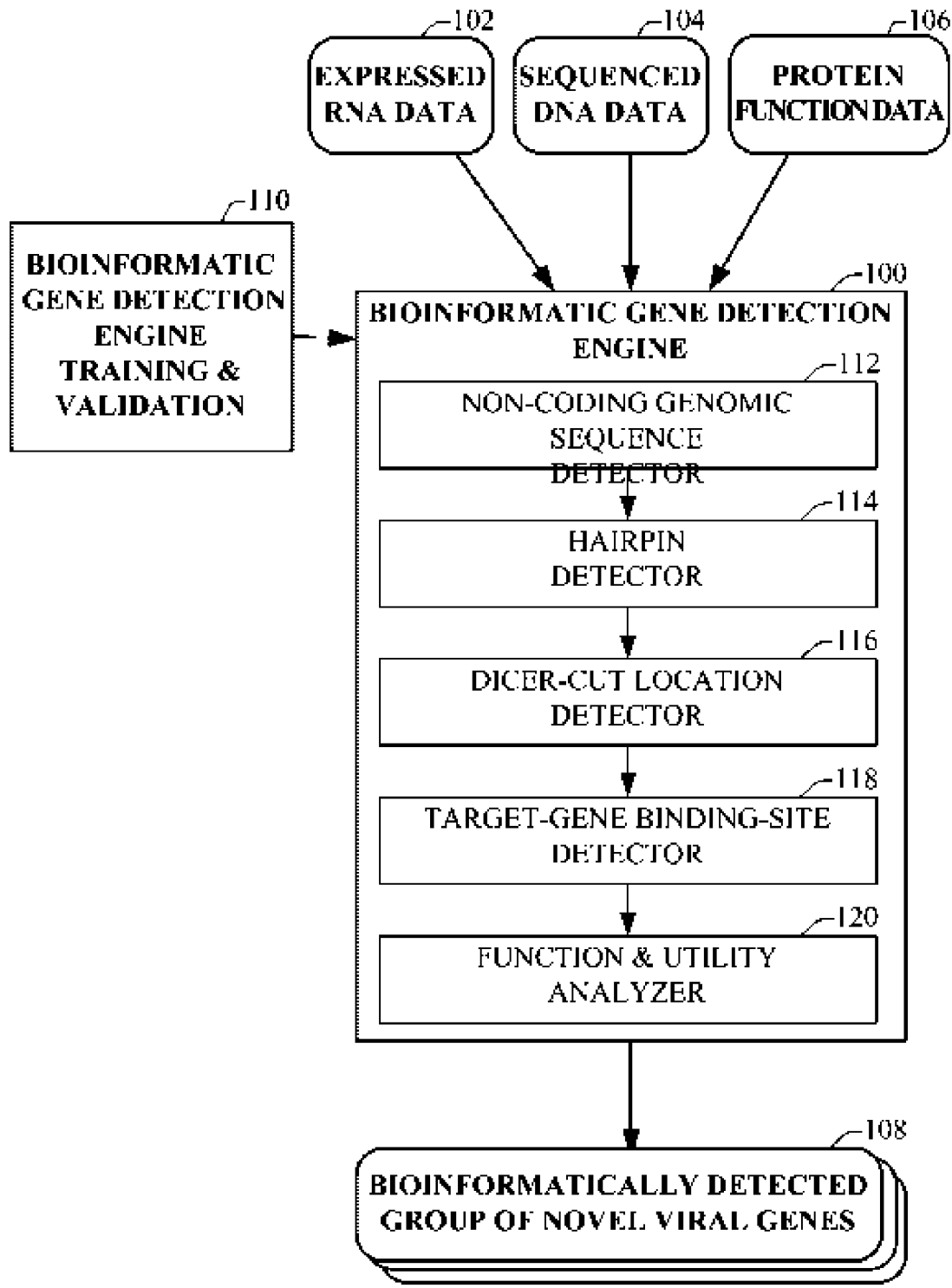
FIG. 2 is a simplified block diagram illustrating a bioinformatic gene detection system capable of detecting genes of the novel group of genes of the present invention, which system is constructed and operative in accordance with a preferred embodiment of the present invention.

Reference is now made to FIG. 2 which is a simplified block diagram illustrating a bioinformatic gene detection system capable of detecting genes of the novel group of genes of the present invention, which system is constructed and operative in accordance with a preferred embodiment of the present invention.

A centerpiece of the present invention is a bioinformatic gene detection engine 100, which is a preferred implementation of a mechanism capable of bioinformatically detecting genes of the novel group of genes of the present invention.

The function of the bioinformatic gene detection engine 100 is as follows: it receives three types of input, expressed RNA data 102, sequenced DNA data 104, and protein function data 106, performs a complex process of analysis of this data as elaborated below, and based on this analysis produces output of a bioinformatically detected group of novel genes designated 108.

Expressed RNA data 102 comprises published expressed sequence tags (EST) data, published mRNA data, as well as other sources of published RNA data. Sequenced DNA data 104 comprises alphanumeric data describing sequenced genomic data, which preferably includes annotation data such as location of known protein coding regions relative to the sequenced data. Protein function data 106 comprises scientific publications reporting studies which elucidated physiological function known proteins, and their connection, involvement and possible utility in treatment and diagnosis of various diseases. Expressed RNA data 102, sequenced DNA data 104 may preferably be obtained from data published by the National Center for Bioinformatics (NCBI) at the National Institute of Health (NIH), as well as from various other published data sources. Protein function data 106 may preferably be obtained from any one of numerous relevant published data sources, such as the Online Mendelian Inherited Disease In Man (OMIM) database developed by john Hopkins University, and also published by NCBI.

Prior to actual detection of bioinformatically detected novel genes 108 by the bioinformatic gene detection engine 100, a process of bioinformatic gene detection engine training & validation designated 110 takes place. This process uses the known miRNA genes as a training set (some 200 such genes have been found to date using biological laboratory means), to train the bioinformatic gene detection engine 100 to bioinformatically recognize miRNA-like genes, and their respective potential target binding sites. Bioinformatic gene detection engine training & validation 110 is further describe hereinbelow with reference to FIG. 3.

The bioinformatic gene detection engine 100 comprises several modules which are preferably activated sequentially, and are described as follows:

A non-coding genomic sequence detector 112 operative to bioinformatically detect non-protein coding genomic sequences. The non-coding genomic sequence detector 112 is further described hereinbelow with reference to FIGS. 4A and 4B.

A hairpin detector 114 operative to bioinformatically detect genomic "hairpin-shaped" sequences, similar to VGAM FOLDED PRECURSOR of FIG. 1. The hairpin detector 114 is further described hereinbelow with reference to FIGS. 5A and 5B.

A dicer-cut location detector 116 operative to bioinformatically detect the location on a hairpin shaped sequence which is enzymatically cut by DICER COMPLEX of FIG. 1. The dicer-cut location detector 116 is further described hereinbelow with reference to FIG. 6A.

A target-gene binding-site detector 118 operative to bioinformatically detect host target having binding sites, the nucleotide sequence of which is partially complementary to that of a given genomic sequence, such as a sequence cut by DICER COMPLEX of FIG. 1. The target-gene binding-site detector 118 is further described hereinbelow with reference to FIGS. 7A and 7B.

A function & utility analyzer 120 operative to analyze function and utility of host target, in order to identify host target which have a significant clinical function and utility. The function & utility analyzer 120 is further described hereinbelow with reference to FIG. 8.

Hardware implementation of the bioinformatic gene detection engine 100 is important, since significant computing power is preferably required in order to perform the computation of bioinformatic gene detection engine 100 in reasonable time and cost. As an example, it is estimated that using one powerful 8-processor PC Server, over 30 months of computing time (at 24 hours per day) would be required in order to detect all miRNA genes in human EST data, and their respective binding sites.

For example, in order to address this challenge at reasonable time and cost, a preferred embodiment of the present invention may comprise a cluster of a large number of personal computers (PCs), such as 100 PCs (Pentium IV, 1.7 GHz, with 40 GB storage each), connected by Ethernet to several strong servers, such as 4 servers (2-CPU, Xeon 2.2 GHz, with 200 GB storage each), combined with an 8-processor server (8-CPU, Xeon 550 Mhz w/8 GB RAM) connected via 2 HBA fiber-channels to an EMC Clariion 100-disks, 3.6 Terabyte storage device. Additionally, preferably an efficient database computer program, such as Microsoft™ SQL-Server database computer program is used and is optimized to the specific requirements of bioinformatic gene detection engine 100. Furthermore, the PCs are preferably optimized to operate close to 100% CPU usage continuously, as is known in the art. Using suitable hardware and software may preferably reduce the required calculation time in the abovementioned example from 30 months to 20 days.

It is appreciated that the abovementioned hardware configuration is not meant to be limiting, and is given as an illustration only. The present invention may be implemented in a wide variety of hardware and software configurations.

The present invention discloses 349 novel viral genes of the VGAM group of genes, which have been detected bioinformatically, as described hereinbelow with reference to Tables 1 and 2. Laboratory confirmation of 4 genes of the GAM group of genes is described hereinbelow with reference to FIGS. 12 through 14.

Figure 3:
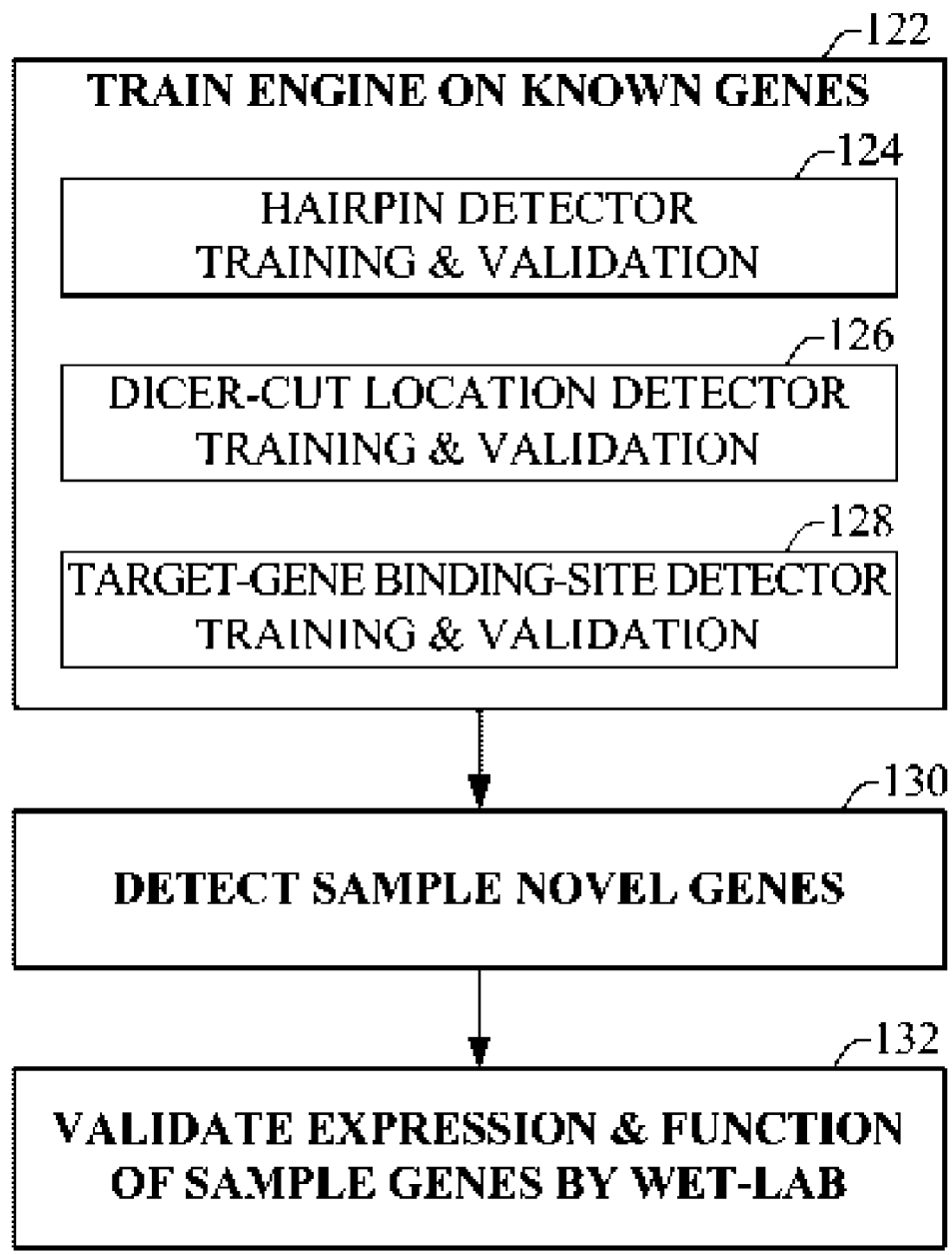
FIG. 3 is a simplified flowchart illustrating operation of a mechanism for training of a computer system to recognize the novel genes of the present invention, which mechanism is constructed and operative in accordance with a preferred embodiment of the present invention.

Reference is now made to FIG. 3 which is a simplified flowchart illustrating operation of a mechanism for training of a computer system to recognize the novel genes of the present invention. This mechanism is a preferred implementation of the bioinformatic gene detection engine training & validation 110 described hereinabove with reference to FIG. 2.

Bioinformatic gene detection engine training & validation 110 of FIG. 2 begins by training the bioinformatic gene detection engine to recognize known miRNA genes, as designated by numeral 122. This training step comprises hairpin detector training & validation 124, further described hereinbelow with reference to FIG. 12 A, dicer-cut location detector training & validation 126, further described hereinbelow with reference to FIGS. 6A and 6B, and target-gene binding-site detector training & validation 128, further described hereinbelow with reference to FIG. 7A.

Next, the bioinformatic gene detection engine 100 is used to bioinformatically detect sample novel genes, as designated by numeral 130. An example of a sample novel gene thus detected is described hereinbelow with reference to FIG. 12.

Finally, wet lab experiments are preferably conducted in order to validate expression and preferably function the sample novel genes detected by the bioinformatic gene detection engine 100 in the previous step. An example of wet-lab validation of the abovementioned sample novel gene bioinformatically detected by the system is described hereinbelow with reference to FIGS. 13A and 13B.

Figure 4A:
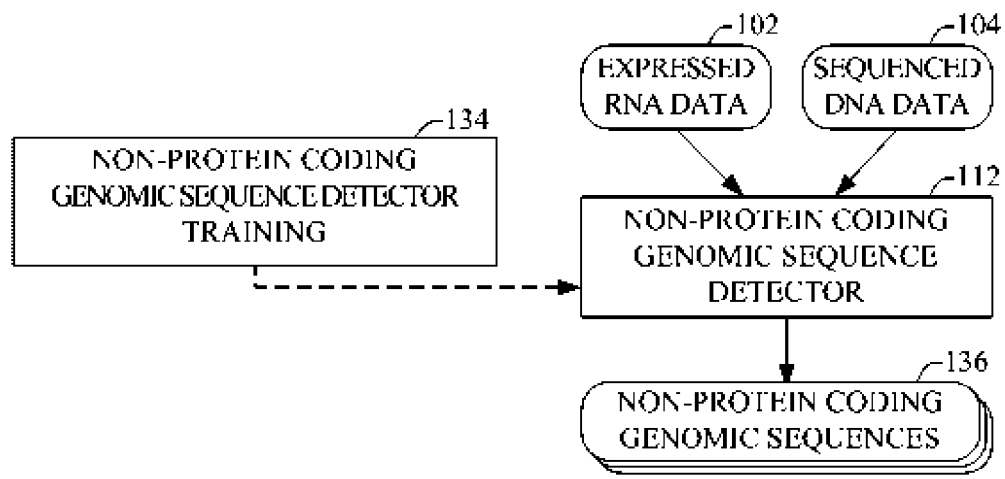
FIG. 4A is a simplified block diagram of a non-coding genomic sequence detector constructed and operative in accordance with a preferred embodiment of the present invention.

Reference is now made to FIG. 4A which is a simplified block diagram of a preferred implementation of the non-coding genomic sequence detector 112 described hereinabove with reference to FIG. 2. Non-protein coding genomic sequence detector 112 of FIG. 2 preferably receives as input at least two types of published genomic data: expressed RNA data 102, including EST data and mRNA data, and sequenced DNA data 104. After its initial training, indicated by numeral 134, and based on the abovementioned input data, the non-protein coding genomic sequence detector 112 produces as output a plurality of non-protein coding genomic sequences 136. Preferred operation of the non-protein coding genomic sequence detector 112 is described hereinbelow with reference to FIG. 4B.

Figure 4B:
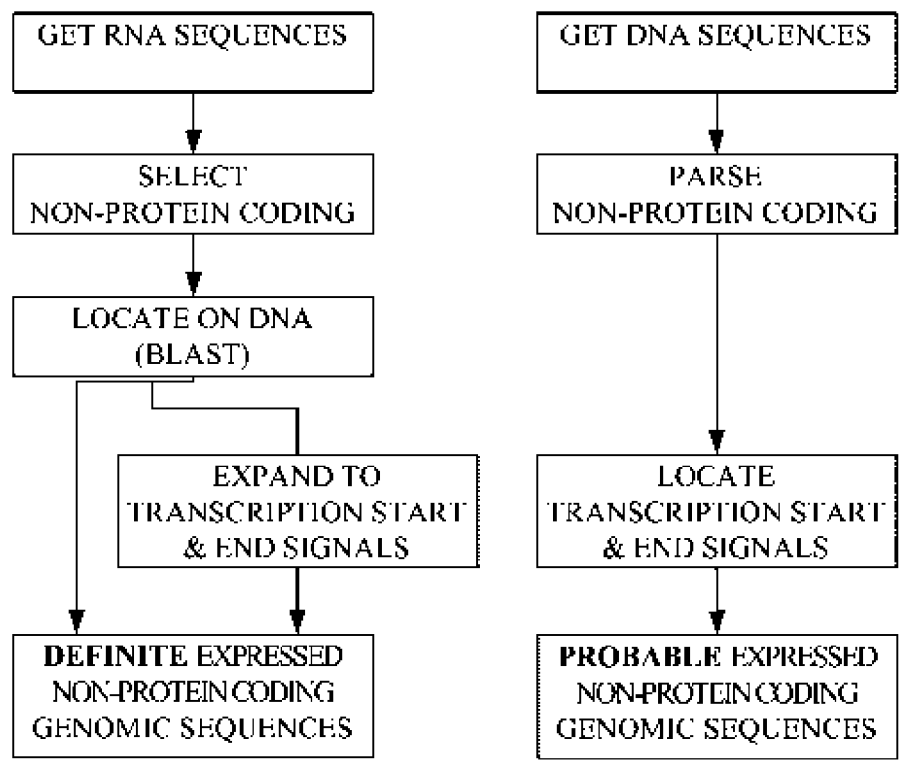
FIG. 4B is a simplified flowchart illustrating operation of a non-coding genomic sequence detector constructed and operative in accordance with a preferred embodiment of the present invention.

Reference is now made to FIG. 4B which is a simplified flowchart illustrating a preferred operation of the non-coding genomic sequence detector 112 of FIG. 2. Detection of non-protein coding genomic sequences to be further analyzed by the system generally preferably progresses in one of the following two paths.

A first path for detecting non-protein coding genomic sequences begins by receiving a plurality of known RNA sequences, such as EST data. Each RNA sequence is first compared to all known protein-coding sequences, in order to select only those RNA sequences which are non-protein coding. This can preferably be performed by BLAST comparison of the RNA sequence to known protein coding sequences. The abovementioned BLAST comparison to the DNA preferably also provides the localization of the RNA on the DNA.

Optionally, an attempt may be made to "expand" the non-protein RNA sequences thus found, by searching for transcription start and end signals, upstream and downstream of location of the RNA on the DNA respectively, as is well known in the art.

A second path for detecting non-protein coding genomic sequences starts by receiving DNA sequences. The DNA sequences are parsed into non protein coding sequences, based on published DNA annotation data: extracting those DNA sequences which are between known protein coding sequences. Next, transcription start and end signals are sought. If such signals are found, and depending on their "strength", probable expressed non-protein coding genomic sequences are yielded.

Figure 5A:
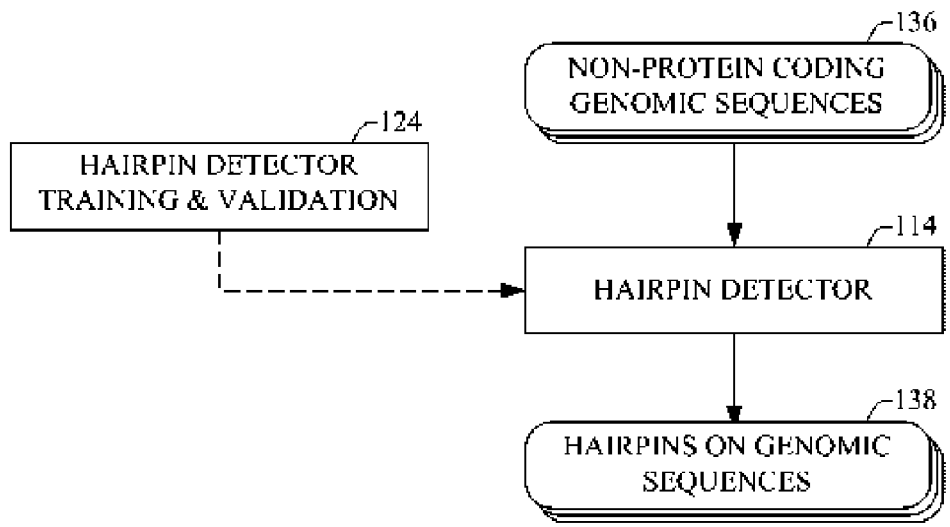
FIG. 5A is a simplified block diagram of a hairpin detector constructed and operative in accordance with a preferred embodiment of the present invention.

Reference is now made to FIG. 5A which is a simplified block diagram of a preferred implementation of the hairpin detector 114 described hereinabove with reference to FIG. 2.

The goal of the hairpin detector 114 is to detect "hairpin" shaped genomic sequences, similar to those of known miRNA genes. As mentioned hereinabove with reference to FIG. 1, a "hairpin" genomic sequence refers to a genomic sequence which "folds onto itself" forming a hairpin like shape, due to the fact that nucleotide sequence of the first half of the nucleotide sequence is an accurate or The hairpin detector 114 of FIG. 2 receives as input a plurality of non-protein coding genomic sequences 136 of FIG. 4A, and after a phase of hairpin detector training & validation 124 of FIG. 3, is operative to detect and output "hairpin shaped" sequences found in the input expressed non-protein coding sequences, designated by numeral 138.

The phase of hairpin detector training & validation 124 is an iterative process of applying the hairpin detector 114 to known hairpin shaped miRNA genes, calibrating the hairpin detector 114 such that it identifies the training set of known hairpins, as well as sequences which are similar thereto. Preferred operation of the hairpin detector 114 is described hereinbelow with reference to FIG. 5B.

Figure 5B:
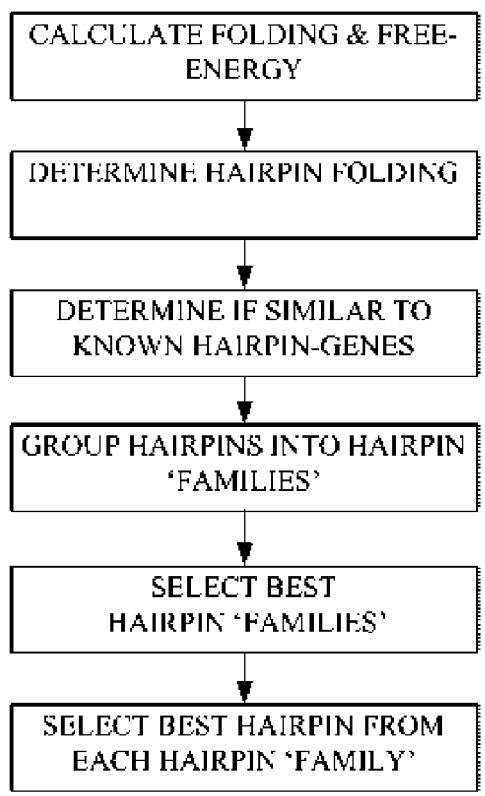
FIG. 5B is a simplified flowchart illustrating operation of a hairpin detector constructed and operative in accordance with a preferred embodiment of the present invention.

Reference is now made to FIG. 5B which is a simplified flowchart illustrating a preferred operation of the hairpin detector 114 of FIG. 2.

A hairpin structure is a two dimensional folding structure, resulting from the nucleotide sequence pattern: the nucleotide sequence of the first half of the hairpin sequence is an inversed-reversed sequence of the second half thereof. Different methodologies are known in the art for detection of various two dimensional and three dimensional hairpin structures.

In a preferred embodiment of the present invention, the hairpin detector 114 initially calculates possible 2-dimensional (2D) folding patterns of a given one of the non-protein coding genomic sequences 136, preferably using a 2D folding algorithm based on free-energy calculation, such as the Zucker algorithm, as is well known in the art.

Next, the hairpin detector 114 analyzes the results of the 2D folding, in order to determine the presence, and location of hairpin structures. A 2D folding algorithm typically provides as output a listing of the base-pairing of the 2D folded shape, i.e. a listing of which all two pairs of nucleotides in the sequence which will bond. The goal of this second step, is to asses this base-pairing listing, in order to determine if it describes a hairpin type bonding pattern.

The hairpin detector 114 then assess those hairpin structures found by the previous step, comparing them to hairpins of known miRNA genes, using various parameters such as length, free-energy, amount and type of mismatches, etc. Only hairpins that bear statistically significant resemblance of the population of hairpins of known miRNAs, according to the abovementioned parameters are accepted.

Lastly, the hairpin detector 114 attempts to select those hairpin structures which are as stable as the hairpins of know miRNA genes. This may be achieved in various manners. A preferred embodiment of the present invention utilizes the following methodology comprising three steps:

First, the hairpin detector 114 attempts to group potential hairpins into "families" of closely related hairpins. As is known in the art, a free-energy calculation algorithm, typically provides multiple "versions" each describing a different possible 2D folding pattern for the given genomic sequence, and the free energy of such possible folding. The hairpin detector 114 therefore preferably assesses all hairpins found on all "versions", grouping hairpins which appear in different versions, but which share near identical locations into a common "family" of hairpins. For example, all hairpins in different versions, the center of which is within 7 nucleotides of each other may preferably be grouped to a single "family".

Next, hairpin "families" are assessed, in order to select only those families which represent hairpins that are as stable as those of known miRNA hairpins. For example, preferably only families which are represented in at least 65% of the free-energy calculation 2D folding versions, are considered stable.

Finally, an attempt is made to select the most suitable hairpin from each selected family. For example, preferably the hairpin which appears in more versions than other hairpins, and in versions the free-energy of which is lower, may be selected.

Figure 6A:
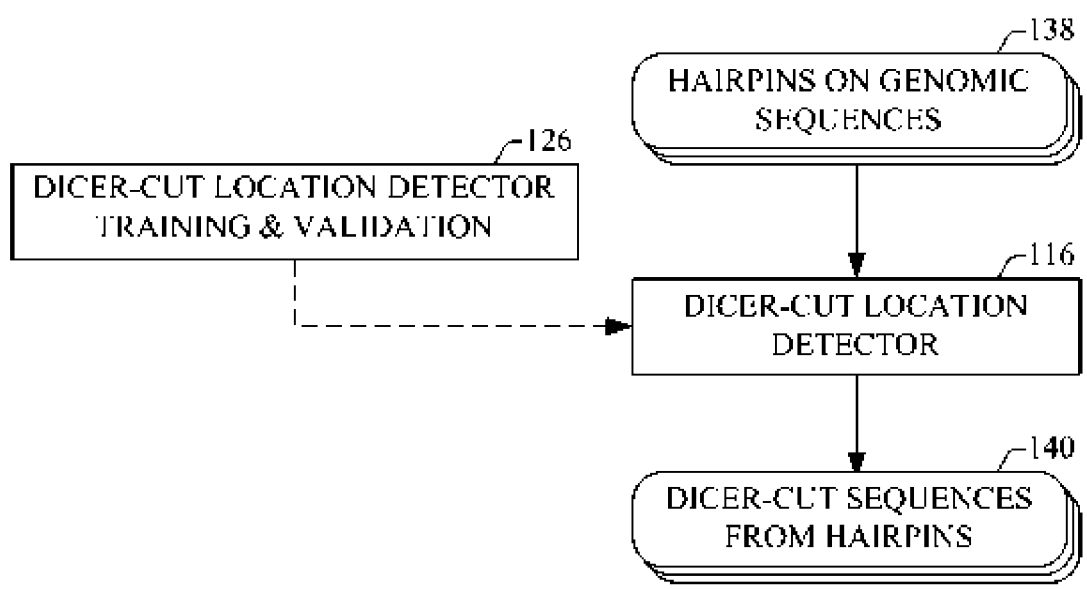
FIG. 6A is a simplified block diagram of a dicer-cut location detector constructed and operative in accordance with a preferred embodiment of the present invention.
Figure 6B:
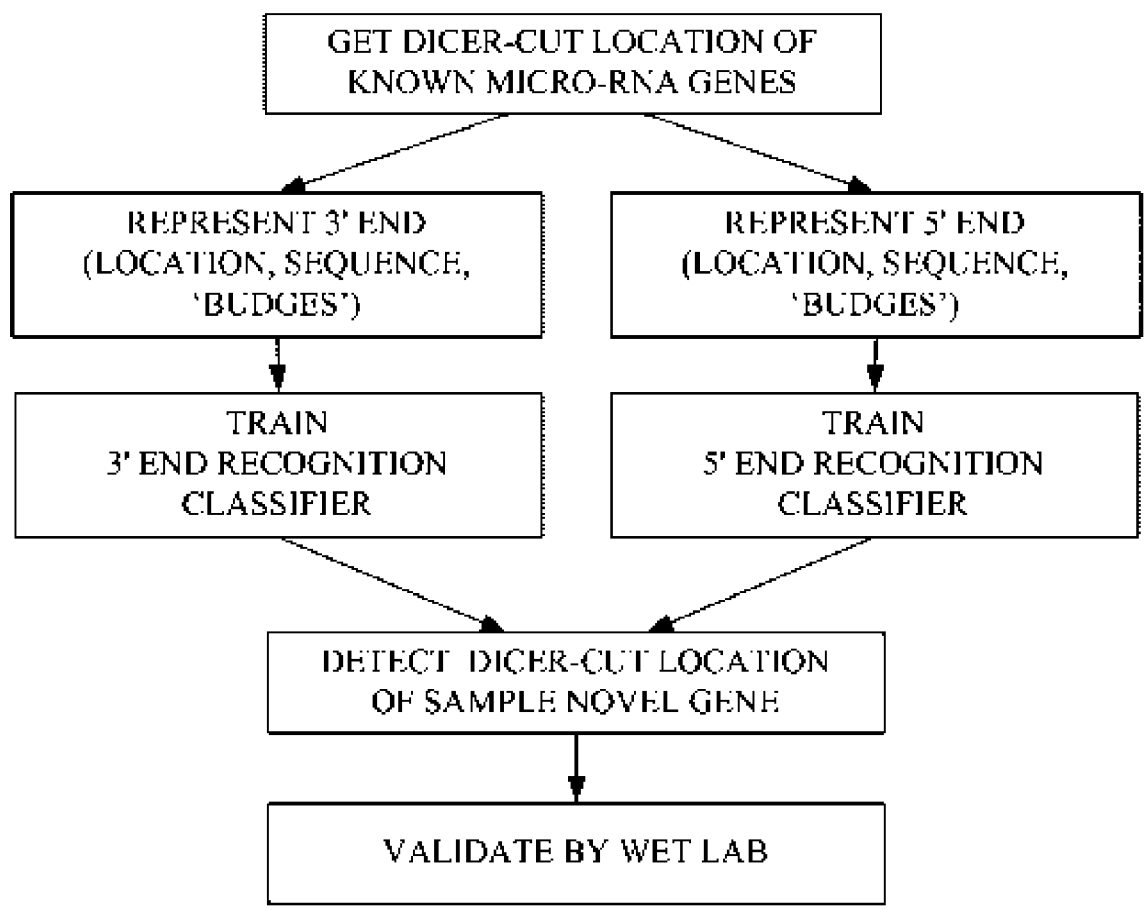
FIG. 6B is a simplified flowchart illustrating training of a dicer-cut location detector constructed and operative in accordance with a preferred embodiment of the present invention.

Reference is now made to FIG. 6A which is a simplified block diagram of a preferred implementation of the dicer-cut location detector 116 described hereinabove with reference to FIG. 2.

The goal of the dicer-cut location detector 116 is to detect the location in which DICER COMPLEX of FIG. 1, comprising the enzyme Dicer, would "dice" the given hairpin sequence, similar to VGAM FOLDED PRECURSOR RNA, yielding VGAM RNA both of FIG. 1.

The dicer-cut location detector 116 of FIG. 2 therefore receives as input a plurality of hairpins on genomic sequences 138 of FIG. 5A, which were calculated by the previous step, and after a phase of dicer-cut location detector training & validation 126 of FIG. 3, is operative to detect a respective plurality of dicer-cut sequences from hairpins 140, one for each hairpin.

In a preferred embodiment of the present invention, the dicer-cut location detector 116 preferably uses a combination of neural networks, Bayesian networks, Markovian modeling, and Support Vector Machines (SVMs) trained on the known dicer-cut locations of known miRNA genes, in order to detect dicer-cut locations. Dicer-cut location detector training & validation 126, which is further described hereinbelow with reference to FIG. 6B.

Figure 6C:
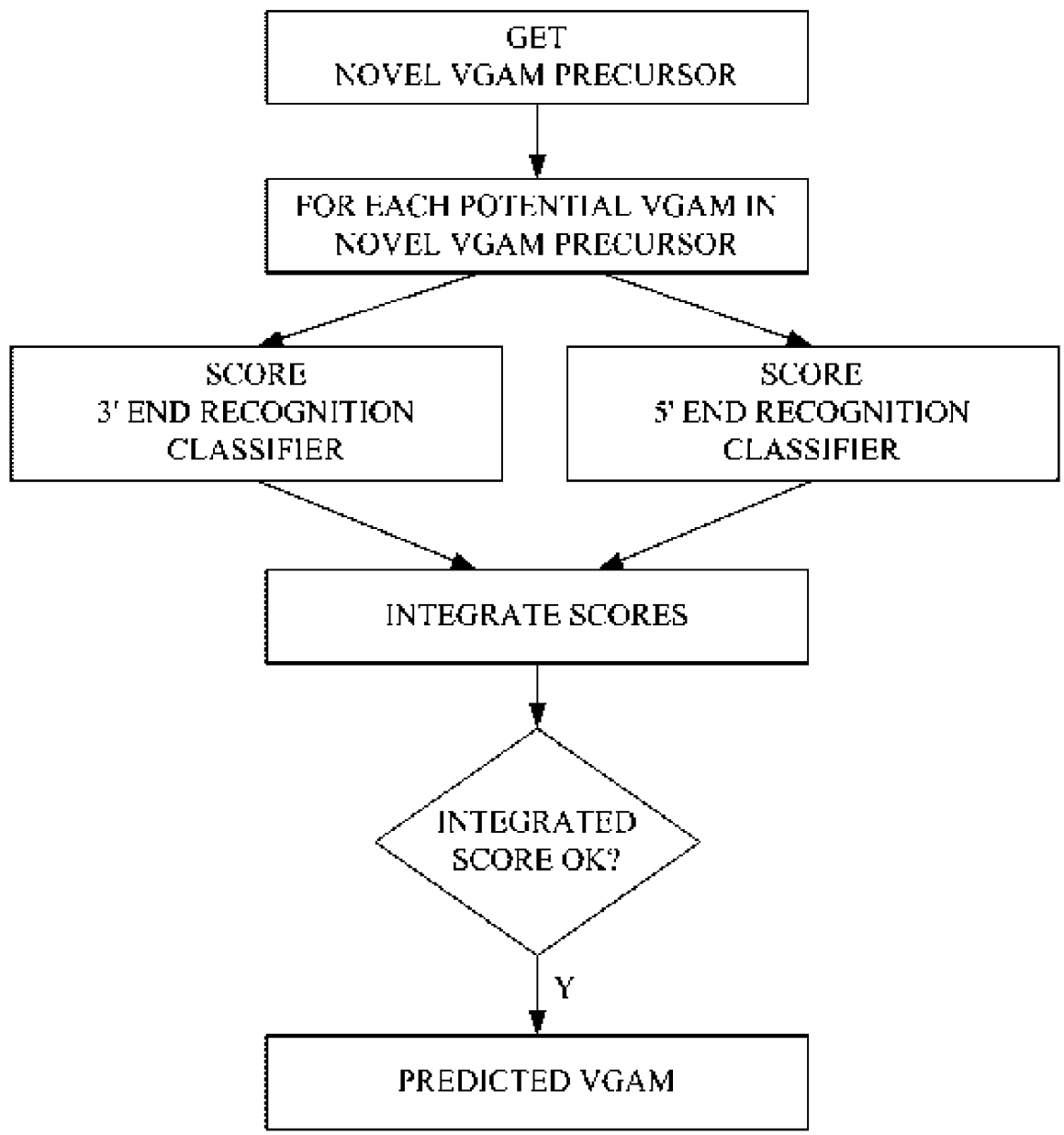
FIG. 6C is a simplified flowchart illustrating prediction of a viral genomic address messenger.

Reference is now made to FIG. 6 B which is a simplified flowchart illustrating a preferred implementation of dicer-cut location detector training & validation 126 of FIG. 3. Dicer-cut location detector 116 first preprocesses known miRNA hairpins and their respective dicer-cut locations, so as to be able to properly analyze them and train the detection system accordingly:

The folding pattern is calculated for each known miRNA, preferably based on free-energy calculation, and the size of the hairpin, the size of the loop at the center of the hairpin, and "bulges" (i.e. mismatched base-pairs) in the folded hairpin are noted.

The dicer-cut location, which is known for known miRNA genes, is noted relative to the above, as well as to the nucleotides in each location along the hairpin. Frequency of identity of nucleotides, and nucleotide-pairing, relative to their location in the hairpin, and relative to the known dicer-cut location in the known miRNA genes is analyzed and modeled.

Different techniques are well known in the art for analysis of existing pattern from a given "training set" of species belonging to a genus, which techniques are then capable, to a certain degree, to detect similar patterns in other species not belonging to the training-set genus. Such techniques include, but are not limited to neural networks, Bayesian networks, Support Vector Machines (SVM), Genetic Algorithms, Markovian modeling, and others, as is well known in the art.

Using such techniques, preferably a combination of several of the above techniques, the known hairpins are represented as a several different networks (such as neural, Bayesian, or SVM) input and output layers. Both nucleotide, and "bulge" (i.e. nucleotide pairing or mismatch) are represented for each position in the hairpin, at the input layer, and a corresponding true/false flag at each position, indicating whether it was diced by dicer at the output layer. Multiple networks are preferably used concurrently, and the results therefrom are integrated and further optimized. Markovian modeling may also be used to validate the results and enhance their accuracy. Finally, the bioinformatic detection of dicer-cut location of a sample novel is confirmed by wet-lab experimentation.

Figure 7A:
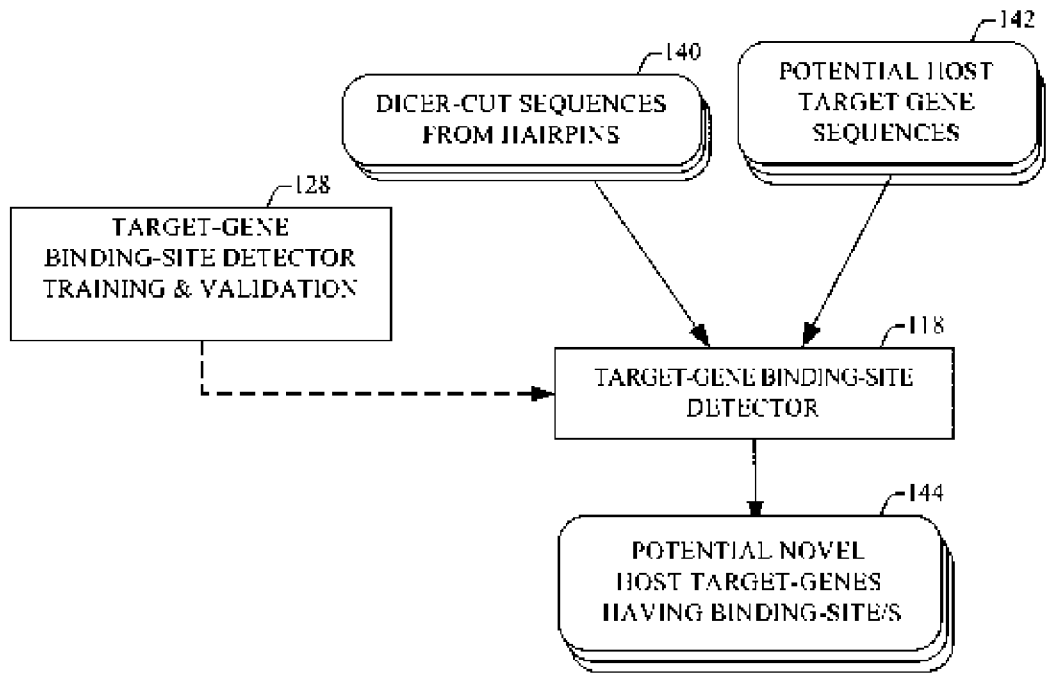
FIG. 7A is a simplified block diagram of a target-gene binding-site detector constructed and operative in accordance with a preferred embodiment of the present invention.

Reference is now made to FIG. 7A which is a simplified block diagram of a preferred implementation of the target-gene binding-site detector 118 described hereinabove with reference to FIG. 2. The goal of the target-gene binding-site detector 118 is to detect a BINDING SITE of FIG. 1, located in an untranslated region of the RNA of a known gene, the nucleotide sequence of which BINDING SITE is at least partially complementary to that of a VGAM RNA of FIG. 1, thereby determining that the abovementioned known gene is a target gene of VGAM of FIG. 1.

The target-gene binding-site detector 118 of FIG. 2 therefore receives as input a plurality of dicer-cut sequences from hairpins 140 of FIG. 6A which were calculated by the previous step, and a plurality of potential target gene sequences 142 which derive sequence DNA data 104 of FIG. 2, and after a phase of target-gene binding-site detector training & validation 128 of FIG. 3, is operative to detect target-genes having binding site/s 144 the nucleotide sequence of which is at least partially complementary to that of each of the plurality of dicer-cut sequences from hairpins 140. Preferred operation of the target-gene binding-site detector is further described hereinbelow with reference to FIG. 7B.

Figure 7B:
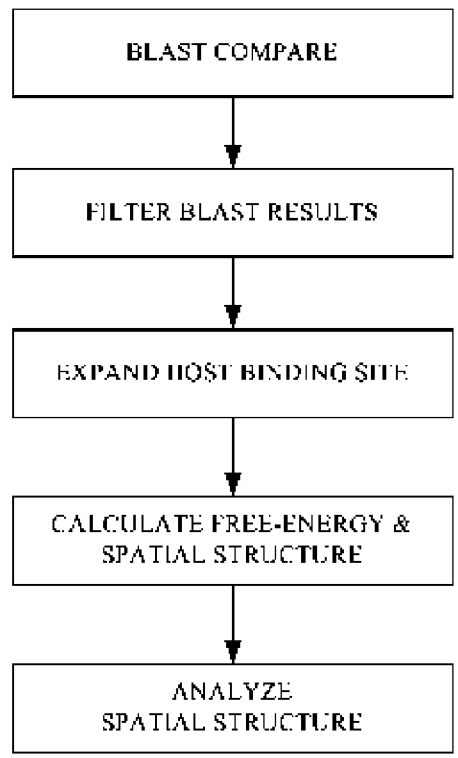
FIG. 7B is a simplified flowchart illustrating operation of a target-gene binding-site detector constructed and operative in accordance with a preferred embodiment of the present invention.

Reference is now made to FIG. 7B which is a simplified flowchart illustrating a preferred operation of the target-gene binding-site detector 118 of FIG. 2. In a preferred embodiment of the present invention, the target-gene binding-site detector 118 first performs a BLAST comparison of the nucleotide sequence of each of the plurality of dicer-cut sequences from hairpins 140, to the potential target gene sequences 142, in order to find crude potential matches. Blast results are then filtered to results which are similar to those of known binding sites (e.g. binding sites of miRNA genes Lin-4 and Let-7 to target genes Lin-14, Lin-41, Lin 28 etc.). Next the binding site is expanded, checking if nucleotide sequenced immediately adjacent to the binding site found by BLAST, may improve the match. Suitable binding sites, then are computed for free-energy and spatial structure. The results are analyzed, selecting only those binding sites, which have free-energy and spatial structure similar to that of known binding sites.

Reference is now made to FIG. 8 which is a simplified flowchart illustrating a preferred operation of the function & utility analyzer 120 described hereinabove with reference to FIG. 2. The goal of the function & utility analyzer 120 is to determine if a potential target gene is in fact a valid clinically useful target gene. Since a potential novel VGAM gene binding a binding site in the UTR of a target gene is understood to inhibit expression of that target gene, and if that target gene is shown to have a valid clinical utility, then in such a case it follows that the potential novel gene itself also has a valid useful function which is the opposite of that of the target gene.

The function & utility analyzer 120 preferably receives as input a plurality of potential novel target genes having binding-site/s 144, generated by the target-gene binding-site detector 118, both of FIG. 7A. Each potential gene, is evaluated as follows:

First the system first checks to see if the function of the potential target gene is scientifically well established. Preferably, this can be achieved bioinformatically by searching various published data sources presenting information on known function of proteins. Many such data sources exist and are published as is well known in the art.

Next, for those target genes the function of which is scientifically known and is well documented, the system then checks if scientific research data exists which links them to known diseases. For example, a preferred embodiment of the present invention utilizes the OMIM™ database published by NCBI, which summarizes research publications relating to genes which have been shown to be associated with diseases.

Finally, the specific possible utility of the target gene is evaluated. While this process too may be facilitated by bioinformatic means, it might require human evaluation of published scientific research regarding the target gene, in order to determine the utility of the target gene to the diagnosis and or treatment of specific disease. Only potential novel genes, the target-genes of which have passed all three examinations, are accepted as novel genes.

Figure 9:
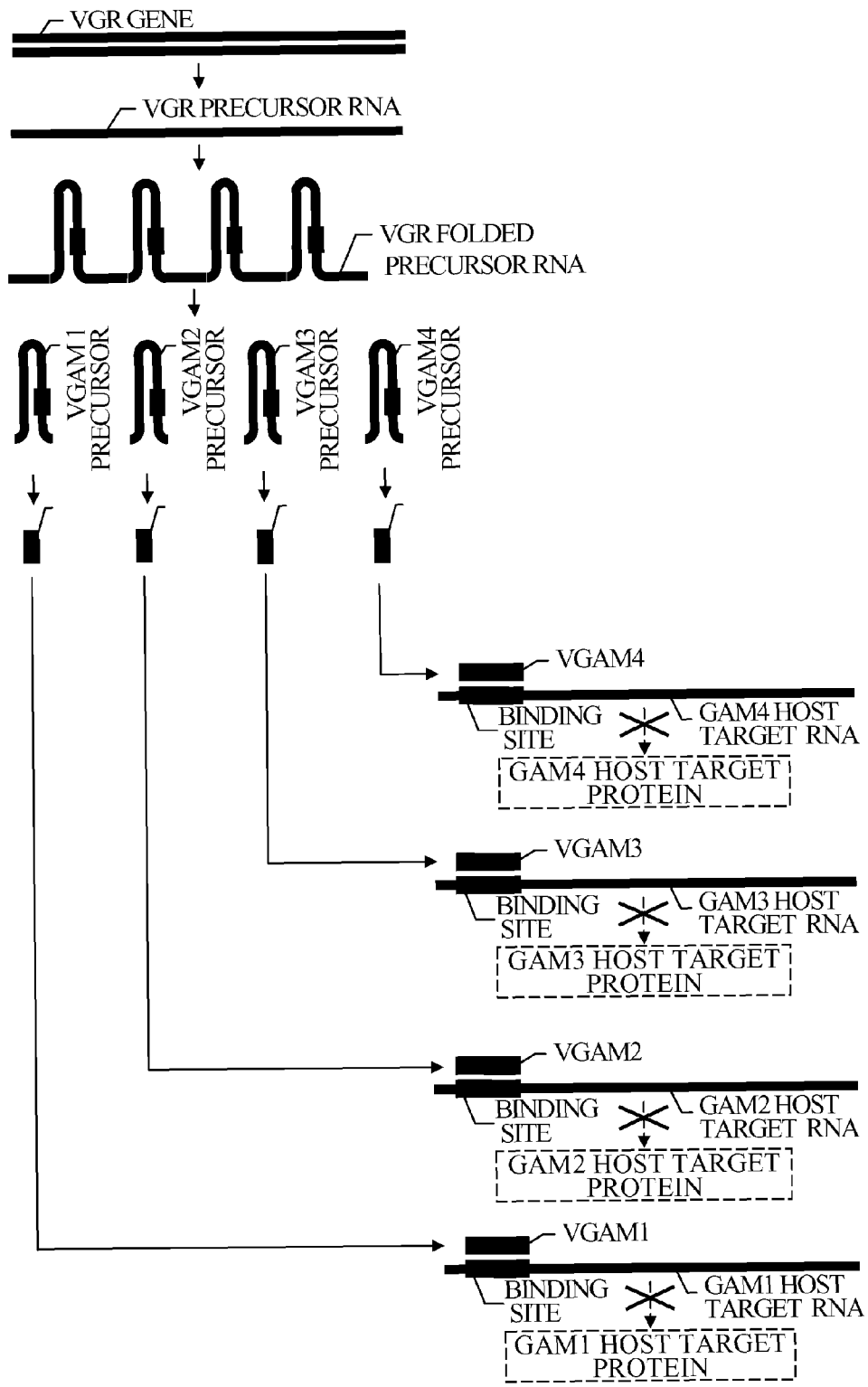
FIG. 9 is a simplified diagram describing a novel bioinformatically detected group of regulatory genes, referred to here as Genomic Record (GR) genes, each of which encodes an "operon-like" cluster of novel miRNA-like genes, which in turn modulates expression of a plurality of target genes.

Reference is now made to FIG. 9, which is a simplified diagram describing a novel bioinformatically detected group of regulatory genes, referred to here as Genomic Record (GR) genes, that encode an "operon-like" cluster of novel miRNA-like genes, each modulating expression of a plurality of host target, the function and utility of which target genes is known.

GR GENE (Genomic Record Gene) is gene of a novel, bioinformatically detected group of regulatory, non protein coding, RNA genes. The method by which GR is detected is described hereinabove with reference to FIGS. 6-15.

GR GENE encodes an RNA molecule, typically several hundred nucleotides long, designated GR PRECURSOR RNA.

GR PRECURSOR RNA folds spatially, as illustrated by GR FOLDED PRECURSOR RNA, into a plurality of what is known in the art as "hair-pin" structures. The nucleotide sequence of GR PRECURSOR RNA comprises a plurality of segments, the first half of each such segment having a nucleotide sequence which is at least a partial inversed-reversed sequence of the second half thereof, thereby causing formation of a plurality of "hairpin" structures, as is well known in the art.

GR FOLDED PRECURSOR RNA is naturally processed by cellular enzymatic activity, into 3 separate hairpin shaped RNA segments, each corresponding to VGAM PRECURSOR RNA of FIG. 1, designated VGAM1 PRECURSOR, VGAM2 PRECURSOR and VGAM3 PRECURSOR respectively.

The above mentioned VGAM precursors, are diced by Dicer of FIG. 1, yielding short RNA segments of about 22 nucleotides in length, each corresponding to VGAM RNA of FIG. 1, designated VGAM1, VGAM2 and VGAM3 respectively.

VGAM1, VGAM2 and VGAM3 each bind complementarily to binding sites located in untranslated regions of respective host target, designated VGAM1-TARGET RNA, VGAM2-TARGET RNA and VGAM3-TARGET RNA respectively. This binding inhibits translation of the respective target proteins designated VGAM1-TARGET PROTEIN, VGAM2-TARGET PROTEIN and VGAM3-TARGET PROTEIN respectively.

The structure of VGAM genes comprised in a GR GENE, and their mode of modulation of expression of their respective target genes is described hereinabove with reference to FIG. 1. The bioinformatic approach to detection of VGAM genes comprised in a GR GENE is described hereinabove with reference to FIGS. 9 through 14.

The present invention discloses 427 novel viral genes of the GR group of genes, which have been detected bioinformatically, as described hereinbelow with reference to Tables 1 and 2. Laboratory confirmation of 3 genes of the GR group of genes is described hereinbelow with reference to FIGS. 9A through 14.

In summary, the current invention discloses a very large number of novel viral GR genes, each of which encodes a plurality of VGAM genes, which in turn may modulate expression of a plurality of host target proteins.

Figure 10:
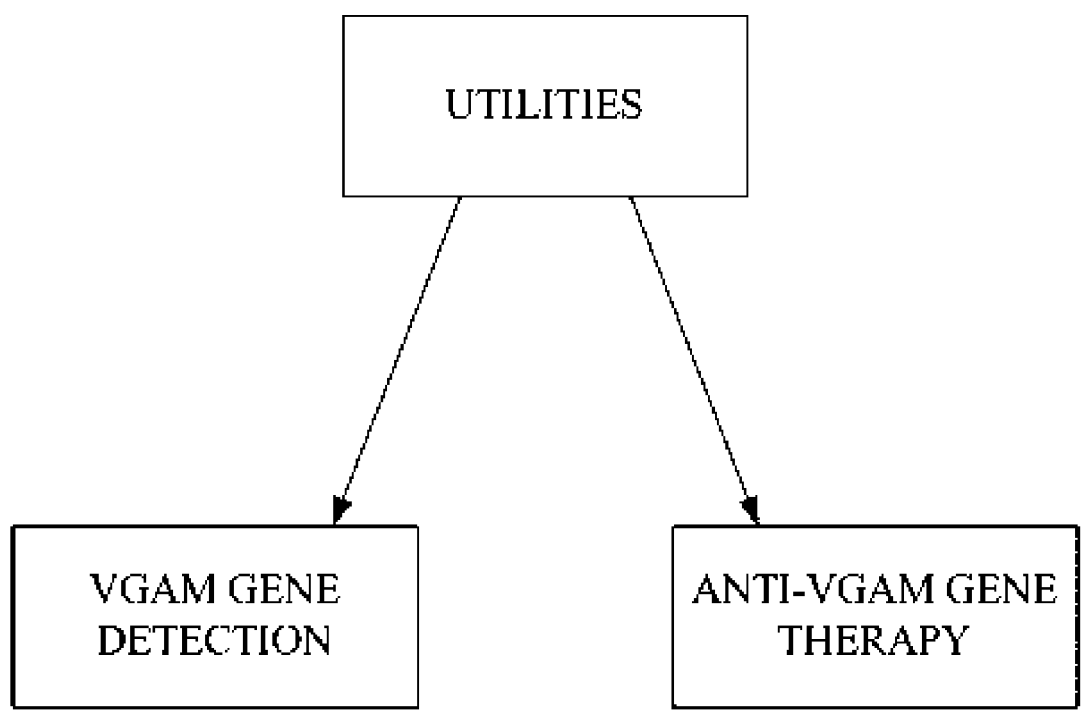
FIG. 10 is a block diagram illustrating different utilities of genes of a novel group of genes, and operons of a novel group of operons, both of the present invention.

Reference is now made to FIG. 10 which is a block diagram illustrating different utilities of genes of the novel group of genes of the present invention referred to here as VGAM genes and GR genes.

The present invention discloses a first plurality of novel genes referred to here as VGAM genes, and a second plurality of operon-like genes referred to here as GR genes, each of the GR genes encoding a plurality of VGAM genes. The present invention further discloses a very large number of known target-genes, which are bound by, and the expression of which is modulated by each of the novel genes of the present invention. Published scientific data referenced by the present invention provides specific, substantial, and credible evidence that the abovementioned target genes modulated by novel genes of the present invention, are associated with various diseases. Specific novel genes of the present invention, target genes thereof and diseases associated therewith, are described hereinbelow with reference to Tables 1 and 2. It is therefore appreciated that a function of VGAM genes and GR genes of the present invention is modulation of expression of target genes related to known diseases, and that therefore utilities of novel genes of the present invention include diagnosis and treatment of the abovementioned diseases. FIG. 10 describes various types of diagnostic and therapeutic utilities of novel genes of the present invention.

A utility of novel genes of the present invention is detection of VGAM genes and of GR genes. It is appreciated that since VGAM genes and GR genes modulate expression of disease related target genes, that detection of expression of VGAM genes in clinical scenarios associated with said diseases is a specific, substantial and credible utility. Diagnosis of novel genes of the present invention may preferably be implemented by RNA expression detection techniques, including but not limited to biochips, as is well known in the art. Diagnosis of expression of genes of the present invention may be useful for research purposes, in order to further understand the connection between the novel genes of the present invention and the abovementioned related diseases, for disease diagnosis and prevention purposes, and for monitoring disease progress.

Another utility of novel genes of the present invention is anti-VGAM gene therapy, a mode of therapy which allows up regulation of a disease related target-gene of a novel VGAM gene of the present invention, by lowering levels of the novel VGAM gene which naturally inhibits expression of that target gene. This mode of therapy is particularly useful with respect to target genes which have been shown to be under-expressed in association with a specific disease. Anti-VGAM gene therapy is further discussed hereinbelow with reference to FIGS. 11A and 11B.

A further utility of novel genes of the present invention is VGAM replacement therapy, a mode of therapy which achieves down regulation of a disease related target-gene of a novel VGAM gene of the present invention, by raising levels of the VGAM gene which naturally inhibits expression of that target gene. This mode of therapy is particularly useful with respect to target genes which have been shown to be over-expressed in association with a specific disease. VGAM replacement therapy involves introduction of supplementary VGAM gene products into a cell, or stimulation of a cell to produce excess VGAM gene products. VGAM replacement therapy may preferably be achieved by transfecting cells with an artificial DNA molecule encoding a VGAM gene, which causes the cells to produce the VGAM gene product, as is well known in the art.

Yet a further utility of novel genes of the present invention is modified VGAM therapy. Disease conditions are likely to exist, in which a mutation in a binding site of a VGAM gene prevents natural VGAM gene to effectively bind inhibit a disease related target-gene, causing up regulation of that target gene, and thereby contributing to the disease pathology. In such conditions, a modified VGAM gene is designed which effectively binds the mutated VGAM binding site, i.e. is an effective anti-sense of the mutated VGAM binding site, and is introduced in disease effected cells. Modified VGAM therapy is preferably achieved by transfecting cells with an artificial DNA molecule encoding the modified VGAM gene, which causes the cells to produce the modified VGAM gene product, as is well known in the art.

An additional utility of novel genes of the present invention is induced cellular differentiation therapy. As aspect of the present invention is finding genes which determine cellular differentiation, as described hereinabove with reference to FIG. 11. Induced cellular differentiation therapy comprises transfection of cell with such VGAM genes thereby determining their differentiation as desired. It is appreciated that this approach may be widely applicable, inter alia as a means for auto transplantation harvesting cells of one cell-type from a patient, modifying their differentiation as desired, and then transplanting them back into the patient. It is further appreciated that this approach may also be utilized to modify cell differentiation in vivo, by transfecting cells in a genetically diseased tissue with a cell-differentiation determining VGAM gene, thus stimulating these cells to differentiate appropriately.

Reference is now made to FIGS. 11A and 11B, simplified diagrams which when taken together illustrate anti-VGAM gene therapy mentioned hereinabove with reference to FIG. 10. A utility of novel genes of the present invention is anti-VGAM gene therapy, a mode of therapy which allows up regulation of a disease related target-gene of a novel VGAM gene of the present invention, by lowering levels of the novel VGAM gene which naturally inhibits expression of that target gene. FIG. 11A shows a normal VGAM gene, inhibiting translation of a target gene of VGAM gene, by binding to a BINDING SITE found in an untranslated region of TARGET RNA, as described hereinabove with reference to FIG. 1.

FIG. 11B shows an example of anti-VGAM gene therapy. ANTI-VGAM RNA is short artificial RNA molecule the sequence of which is an anti-sense of VGAM RNA. Anti-VGAM treatment comprises transfecting diseased cells with ANTI-VGAM RNA, or with a DNA encoding thereof. The ANTI-VGAM RNA binds the natural VGAM RNA, thereby preventing binding of natural VGAM RNA to its BINDING SITE. This prevents natural translation inhibition of TARGET RNA by VGAM RNA, thereby up regulating expression of TARGET PROTEIN.

It is appreciated that anti-VGAM gene therapy is particularly useful with respect to target genes which have been shown to be under-expressed in association with a specific disease.

Reference is now made to FIG. 12A which is an annotated sequence of an EST comprising a novel gene detected by the gene detection system of the present invention. FIG. 12A shows the nucleotide sequence of a known human non-protein coding EST (Expressed Sequence Tag), identified as EST72223 (SEQ ID NO: 3751). It is appreciated that the sequence of this EST comprises sequences of one known miRNA gene, identified as MIR-98, and of one novel GAM gene, referred to here as GAM24, detected by the bioinformatic gene detection system of the present invention, described hereinabove with reference to FIG. 2.

Reference is now made to FIGS. 12B and 12C that are pictures of laboratory results, which when taken together demonstrate laboratory confirmation of expression of the bioinformatically detected novel gene of FIG. 12A. Reference is now made to FIG. 12B which is a Northern blot analysis of MIR-98 and EST72223 transcripts. MIR-98 and EST72223 were reacted with MIR-98 and GAM24 probes as indicated in the figure. It is appreciated that the probes of both MIR-98 and GAM24 reacted with EST72223, indicating that EST72223 contains the sequences of MIR-98 and of GAM24. It is further appreciated that the probe of GAM24 does not cross-react with MIR-98.

Reference is now made to FIG. 12C. A Northern blot analysis of EST72223 and MIR-98 transfections were performed, subsequently marking RNA by the MIR-98 and GAM24 probes. Left, Northern reacted with MIR-98, Right, Northern reacted with GAM24. The molecular Sizes of EST72223, MIR-98 and GAM24 are indicated by arrows. Hela are control cells that have not been introduced to exogenous RNA. EST and MIR-98 Transfections are RNA obtained from Hela transfected with EST72223 and MIR-98, respectively. MIR-98 and EST are the transcripts used for the transfection experiment. The results indicate that EST72223, when transfected into Hela cells, is cut yielding known miRNA gene MIR-98 and novel miRNA gene GAM24.

Reference is now made to FIG. 12D, which is a Northern blot of a lisate experiment with MIR-98 and GAM24. Northern blot analysis of hairpins in EST72223. Left, Northern reacted with predicted Mir-98 hairpin probe, Right, Northern reacted with predicted GAM24 hairpin probe. The molecular size of EST is indicated by arrow. The molecular sizes of Mir-98 and GAM24 are 80 nt and 100 nt, respectively as indicated by arrows. The 22 nt molecular marker is indicated by arrow. 1-Hela lysate; 2-EST incubated 4 h with Hela lysate; 3-EST without lysate; 4-Mir transcript incubated 4 h with Hela lysate; 5-Mir transcript incubated overnight with Hela lysate; 6-Mir transcript without lysate; 7-RNA extracted from Hela cells following transfection with Mir transcript.

Technical methods used in experiments, the results of which are depicted in FIGS. 12B, 12C and 12D are as follows:

Transcript preparations: Digoxigenin (DIG) labeled transcripts were prepared from EST72223 (TIGER), MIR98 and predicted precursor hairpins by using a DIG RNA labeling kit (Roche Molecular Biochemicals) according to the manufacturer's protocol. Briefly, PCR products with T7 promoter at the 5" end or T3 promoter at the 3" end were prepared from each DNA in order to use it as a template to prepare sense and antisense transcripts, respectively. MIR-98 was amplified using EST72223 as a template with T7miR98 forward primer: 5-"TAATAC GACTCACTATAGGGTGAGGTAG-TAAGTTGTATTGTT-3" (SEQ ID NO: 3754) and T3miR98 reverse primer: 5"-AATTAACCCTCACTAAAGGGAAAG-TAGTAAGTTGTATAG TT-3" (SEQ ID NO: 3755). EST72223 was amplified with T7-EST 72223 forward primer: 5"-TAATACGACTCACTATAGG CCCTTATTA-GAGGATTCTGCT-3" (SEQ ID NO: 3756) and T3-EST72223 reverse primer: 5"-AATTAACCCTCAC-TAAAGG TTTTTTTTTCCTGAGACAGAGT-3" (SEQ ID NO: 3757). Bet-4 was amplified using EST72223 as a template with Bet-4 forward primer: 5"-GAGGCAGGAGAAT-TGCTTGA-3" (SEQ ID NO: 3758) and T3-EST72223 reverse primer: 5"-AAT TAACCCTCACTAAAGGCCT-GAGACAGAGTCTTGCTC-3" (SEQ ID NO: 3759). The PCR products were cleaned and used for DIG-labeled or unlabeled transcription reactions with the appropriate polymerase. For transfection experiments, CAP reaction was performed by using a mMessage mMachine kit (Ambion).

Transfection procedure: Transfection of Hela cells was performed by using TransMessenger reagent (Qiagen) according to the manufacture's protocol. Briefly, Hela cells were seeded to 1-2×10^6 cells per plate a day before transfection. Two µg RNA transcripts were mixed with 8 µl Enhancer in a final volume of 100 µl, mixed and incubated at room temperature for 5 min. 16 µl TransMessenger reagent was added to the RNA-Enhancer, mixed and incubated for additional 10 min. Cell plates were washed with sterile PBS twice and then incubated with the transfection mix diluted with 2.5 ml DMEM medium without serum. Cells were incubated with transfection mix for three hours under their normal growth condition (370 C and 5% CO2) before the transfection mix was removed and a fresh DMEM medium containing serum was added to the cells. Cells were left to grow 48 hours before harvesting.

Target RNA cleavage assay: Cap-labeled target RNAs were generated using mMessage mMachine™ (Ambion). Caped RNA transcripts were preincubated at 30° C. for 15 min in supplemented Hela S100 obtained from Computer Cell Culture, Mos, Belgium. After addition of all components, final concentrations were 100 mM target RNA, 1 m M ATP, 0.2 mM GTP, 10 U/ml RNasin, 30 µg/ml creatine kinase, 25 mM creatine phosphate, and 50% S100 extract. Incubation was continued for 4 hours to overnight. Cleavage reaction was stopped by the addition of 8 volumes of proteinase K buffer (200 Mm Tris-Hcl, pH 7.5, 25 m M EDTA, 300 mM NaCl, and 2% SDS). Proteinase K, dissolved in 50 mM Tris-HCl, pH 8, 5 m M CaCl2, and 50% glycerol, was added to a final concentration of 0.6 mg/ml. Sample were subjected to phenol/chlorophorm extraction and kept frozen until analyzed by urea-TBE PAGE.

Northern analysis: RNAs were extracted from cells by using Tri-reagent according to the manufacture's protocol. The RNAs were dissolved in water and heated to 650 C to disrupt any association of the 25 nt RNA with larger RNA molecules. RNA were placed on ice and incubated for 30 min with PEG (MW=8000) in a final concentration of 5% and NaCl in a final concentration of 0.5M to precipitate high molecular weight nucleic acid. The RNAs were centrifuged at 10,000×g for 10 min to pellet the high molecular weight nucleic acid. The supernatant containing the low molecular weight RNAs was collected and three volumes of ethanol was added. The RNAs were placed at −200 C for at least two hours and then centrifuged at 10,000×g for 10 min. The pellets were dissolved in Urea-TBE buffer (1×tbe, 7M urea) for further analysis by a Northern blot.

RNA samples were boiled for 5 min before loading on 15%-8% polyacrylamide (19:1) gels containing 7M urea and 1×TBE. Gels were run in 1×TBE at a constant voltage of 300V and then transferred into a nylon membrane. The membrane was exposed to 3 min ultraviolet light to cross link the RNAs to the membrane. Hybridization was performed overnight with DIG-labeled probes at 420 C. Membranes were washed twice with SSC×2 and 0.2% SDS for 10 min. at 420 C and then washed twice with SSC×0.5 for 5 min at room temperature. The membrane was then developed by using a DIG luminescent detection kit (Roche) using anti DIG and CSPD reaction, according to the manufacture's protocol.

It is appreciated that the data presented in FIGS. 12A, 12B, 12C and 12D, when taken together validate the function of the bioinformatic gene detection engine 100 of FIG. 2. FIG. 12A shows a novel GAM gene bioinformatically detected by the bioinformatic gene detection engine 100, and FIGS. 12B, 12C and 12D show laboratory confirmation of the expression of this novel gene. This is in accord with the engine training and validation methodology described hereinabove with reference to FIG. 3.

Reference is now made to FIG. 13A which is an annotated sequence of an EST comprising a novel gene detected by the gene detection system of the present invention. FIG. 13A shows the nucleotide sequence of a known human non-protein coding EST (Expressed Sequence Tag), identified as EST 7929020 (SEQ ID NO: 3752). It is appreciated that the sequence eof this EST comprises sequences of two novel GAM genes, referred to here as GAM23 and GAM25, detected by the bioinformatic gene detection system of the present invention, described hereinabove with reference to FIG. 2.

Reference is now made to FIG. 13B which presents pictures of laboratory results, that demonstrate laboratory confirmation of expression of the bioinformatically detected novel gene of FIG. 13A. Northern blot analysis of hairpins in EST7929020. Left, Northern reacted with predicted GAM25 hairpin probe, Right, Northern reacted with predicted GAM23 hairpin probe. The molecular size of EST is indicated by arrow. The molecular sizes of GAM23 and GAM25 are 60 nt, as indicated by arrow. The 22 nt molecular marker is indicated by arrow. 1-Hela lysate; 2-EST incubated 4 h with Hela lysate; 3-EST incubated overnight with Hela lysate; 4-EST without lysate; 5-GAM transcript; 6-GAM 22 nt marker; 7-GAM PCR probe; 8-RNA from control Hela cells; 9-RNA extracted from Hela cells following transfection with EST.

Figure 13C:
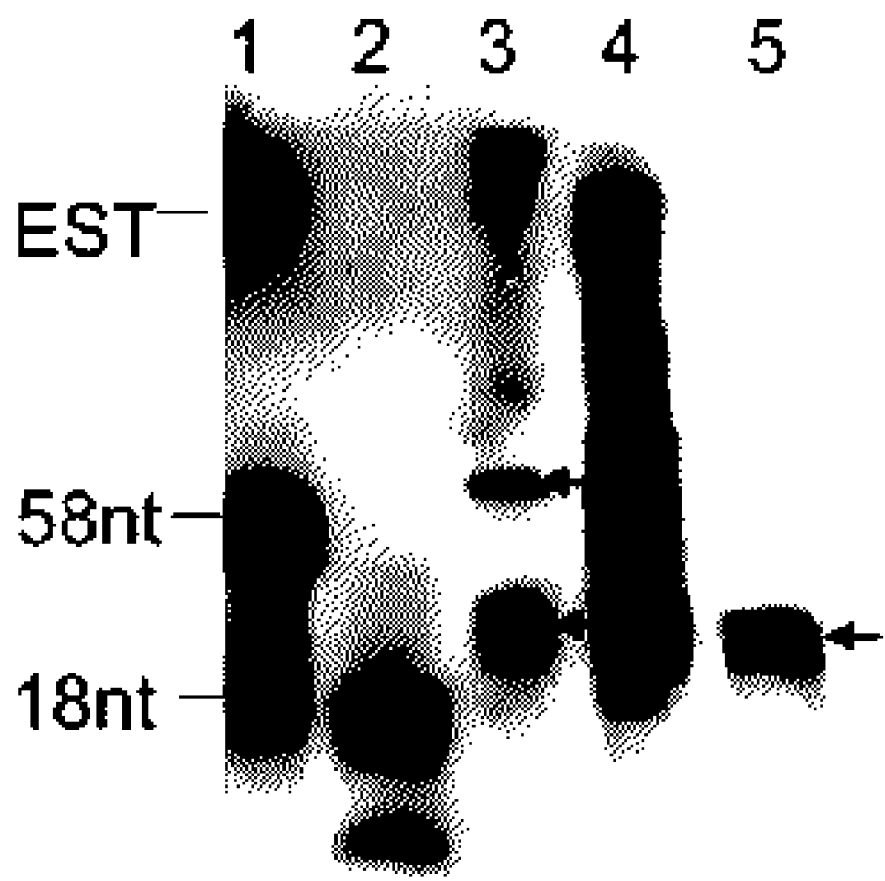
FIG. 13C is a picture of laboratory results, which confirm endogenous-expression of bioinformatically detected novel gene GAM25 of FIG. 13A.

Reference is now made to FIG. 13C which is a picture of a Northern blot confirming Endogenous expression of bioinformatically detected gene GAM25 of FIG. 13A from in Hela cells. Northern was reacted with a predicted GAM25 hairpin probe. The molecular size of EST7929020 is indicated. The molecular sizes of GAM25 is 58 nt, as indicated. A 19 nt DNA oligo molecular marker is indicated. Endogenous expression of GAM25 in Hela total RNA fraction and in S-100 fraction is indicated by arrows. 1-GAM25 transcript; 2-GAM25 DNA oligo marker; 3-RNA from control Hela cells; 4-RNA extracted from Hela cells following transfection with EST; 5-RNA extracted from S-100 Hela lysate.

Reference is now made to FIG. 14A which is an annotated sequence of an EST comprising a novel gene detected by the gene detection system of the present invention. FIG. 14A shows the nucleotide sequence of a known human non-protein coding EST (Expressed Sequence Tag), identified as EST 1388749 (SEQ ID NO: 3753). It is appreciated that the sequence of this EST comprises sequence of a novel GAM gene, referred to here as GAM26, detected by the bioinformatic gene detection system of the present invention, described hereinabove with reference to FIG. 2.

Reference is now made to FIG. 14B which is a picture of Northern blot analysis, confirming expression of novel bioinformatically detected gene GAM26, and natural processing there of from EST1388749. Northern reacted with predicted GAM26 hairpin probe. The molecular size of EST is indicated by arrow. The molecular sizes of GAM26 is 130 nt, as indicated by arrow. The 22 nt molecular marker is indicated by arrow. 1-Hela lysate; 2-EST incubated 4 h with Hela lysate; 3-EST incubated overnight with Hela lysate; 4-EST without lysate; 5-GAM transcript; 6-GAM 22 nt marker; 7-GAM PCR probe.

FIG. 1 further provides a conceptual description of a novel bioinformatically detected viral gene of the present invention, referred to here as Viral Genomic Address Messenger 15 (VGAM15) viral gene, which modulates expression of respective host target genes thereof, the function and utility of which host target genes is known in the art.

VGAM15 is a novel bioinformatically detected regulatory, non protein coding, viral micro RNA (miRNA) gene. The method by which VGAM15 was detected is described hereinabove with reference to FIGS. 2-8.

VGAM15 gene, herein designated VGAM GENE, is a viral gene contained in the genome of Vaccinia virus. VGAM15 host target gene, herein designated VGAM HOST TARGET GENE, is a human gene contained in the human genome.

VGAM15 gene, herein designated VGAM GENE, encodes a VGAM15 precursor RNA, herein designated VGAM PRECURSOR RNA. Similar to other miRNA genes, and unlike most ordinary genes, VGAM15 precursor RNA, herein designated VGAM PRECURSOR RNA, does not encode a protein. A nucleotide sequence identical or highly similar to the nucleotide sequence of VGAM15 precursor RNA is designated SEQ ID:1, and is provided hereinbelow with reference to the sequence listing part. Nucleotide sequence SEQ ID:1 is located at position 190678 relative to the genome of Vaccinia virus.

VGAM15 precursor RNA, herein designated VGAM PRECURSOR RNA, folds onto itself, forming VGAM15 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM15 folded precursor RNA, herein designated VGAM FOLDED PRECURSOR RNA, into VGAM15 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM15 RNA is designated SEQ ID:350, and is provided hereinbelow with reference to the sequence listing part.

VGAM15 host target gene, herein designated VGAM HOST TARGET GENE, encodes a corresponding messenger RNA, VGAM15 host target RNA, herein designated VGAM HOST TARGET RNA. VGAM15 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM15 RNA, herein designated VGAM RNA, binds complementarily to one or more host target binding sites located in untranslated regions of VGAM15 host target RNA, herein designated VGAM HOST TARGET RNA. This complementary binding is due to the fact that the nucleotide sequence of VGAM15 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM15 RNA, herein designated VGAM RNA, may have a different number of host target binding sites in untranslated regions of a VGAM15 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM15 RNA, herein designated VGAM RNA, to host target binding sites on VGAM15 host target RNA, herein designated VGAM HOST TARGET RNA, such as BINDING SITE I, BINDING SITE II and BINDING SITE III, inhibits translation of VGAM15 host target RNA, herein designated VGAM HOST TARGET RNA, into VGAM15 host target protein, herein designated VGAM HOST TARGET PROTEIN. VGAM host target protein is therefore outlined by a broken line.

It is appreciated that VGAM15 host target gene, herein designated VGAM HOST TARGET GENE, in fact represents a plurality of VGAM15 host target genes. The mRNA of each one of this plurality of VGAM15 host target genes comprises one or more host target binding sites, each having a nucleotide sequence which is at least partly complementary to VGAM15 RNA, herein designated VGAM RNA, and which when bound by VGAM15 RNA, herein designated VGAM RNA, causes inhibition of translation of respective one or more VGAM15 host target proteins.

It is further appreciated by one skilled in the art that the mode of translational inhibition illustrated by FIG. 1 with specific reference to translational inhibition exerted by VGAM15 gene, herein designated VGAM GENE, on one or more VGAM15 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM15 is inhibition of expression of host target genes, as part of a novel viral mechanism of attacking a host. Accordingly, utilities of VGAM15 include diagnosis, prevention and treatment of viral infection by Vaccinia virus. Specific functions, and accordingly utilities, of VGAM15 correlate with, and may be deduced from, the identity of the host target genes which VGAM15 binds and inhibits, and the function of these host target genes, as elaborated hereinbelow.

Nucleotide sequences of the VGAM15 precursor RNA, herein designated VGAM PRECURSOR RNA, and of the diced VGAM15 RNA, herein designated VGAM RNA, and a schematic representation of the secondary folding of VGAM15 folded precursor RNA, herein designated VGAM FOLDED PRECURSOR RNA, of VGAM15 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM15 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 16 (VGAM16) viral gene, which modulates expression of respective host target genes thereof, the function and utility of which host target genes is known in the art.

VGAM16 is a novel bioinformatically detected regulatory, non protein coding, viral micro RNA (miRNA) gene. The method by which VGAM16 was detected is described hereinabove with reference to FIGS. 2-8.

VGAM16 gene, herein designated VGAM GENE, is a viral gene contained in the genome of Vaccinia virus. VGAM16 host target gene, herein designated VGAM HOST TARGET GENE, is a human gene contained in the human genome.

VGAM16 gene, herein designated VGAM GENE, encodes a VGAM16 precursor RNA, herein designated VGAM PRECURSOR RNA. Similar to other miRNA genes, and unlike most ordinary genes, VGAM16 precursor RNA, herein designated VGAM PRECURSOR RNA, does not encode a protein. A nucleotide sequence identical or highly similar to the nucleotide sequence of VGAM16 precursor RNA is designated SEQ ID:2, and is provided hereinbelow with reference to the sequence listing part. Nucleotide sequence SEQ ID:2 is located at position 188927 relative to the genome of Vaccinia virus.

VGAM16 precursor RNA, herein designated VGAM PRECURSOR RNA, folds onto itself, forming VGAM16 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM16 folded precursor RNA, herein designated VGAM FOLDED PRECURSOR RNA, into VGAM16 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM16 RNA is designated SEQ ID:351, and is provided hereinbelow with reference to the sequence listing part.

VGAM16 host target gene, herein designated VGAM HOST TARGET GENE, encodes a corresponding messenger RNA, VGAM16 host target RNA, herein designated VGAM HOST TARGET RNA. VGAM16 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM16 RNA, herein designated VGAM RNA, binds complementarily to one or more host target binding sites located in untranslated regions of VGAM16 host target RNA, herein designated VGAM HOST TARGET RNA. This complementary binding is due to the fact that the nucleotide sequence of VGAM16 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM16 RNA, herein designated VGAM RNA, may have a different number of host target binding sites in untranslated regions of a VGAM16 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM16 RNA, herein designated VGAM RNA, to host target binding sites on VGAM16 host target RNA, herein designated VGAM HOST TARGET RNA, such as BINDING SITE I, BINDING SITE II and BINDING SITE III, inhibits translation of VGAM16 host target RNA, herein designated VGAM HOST TARGET RNA, into VGAM16 host target protein, herein designated VGAM HOST TARGET PROTEIN. VGAM host target protein is therefore outlined by a broken line.

It is appreciated that VGAM16 host target gene, herein designated VGAM HOST TARGET GENE, in fact represents a plurality of VGAM16 host target genes. The mRNA of each one of this plurality of VGAM16 host target genes comprises one or more host target binding sites, each having a nucleotide sequence which is at least partly complementary to VGAM16 RNA, herein designated VGAM RNA, and which when bound by VGAM16 RNA, herein designated VGAM RNA, causes inhibition of translation of respective one or more VGAM16 host target proteins.

It is further appreciated by one skilled in the art that the mode of translational inhibition illustrated by FIG. 1 with specific reference to translational inhibition exerted by VGAM16 gene, herein designated VGAM GENE, on one or more VGAM16 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM16 is inhibition of expression of host target genes, as part of a novel viral mechanism of attacking a host. Accordingly, utilities of VGAM16 include diagnosis, prevention and treatment of viral infection by Vaccinia virus. Specific functions, and accordingly utilities, of VGAM16 correlate with, and may be deduced from, the identity of the host target genes which VGAM16 binds and inhibits, and the function of these host target genes, as elaborated hereinbelow.

Nucleotide sequences of the VGAM16 precursor RNA, herein designated VGAM PRECURSOR RNA, and of the diced VGAM16 RNA, herein designated VGAM RNA, and a schematic representation of the secondary folding of VGAM16 folded precursor RNA, herein designated VGAM FOLDED PRECURSOR RNA, of VGAM16 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM16 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 17 (VGAM17) viral gene, which modulates expression of respective host target genes thereof, the function and utility of which host target genes is known in the art.

VGAM17 is a novel bioinformatically detected regulatory, non protein coding, viral micro RNA (miRNA) gene. The method by which VGAM17 was detected is described hereinabove with reference to FIGS. 2-8.

VGAM17 gene, herein designated VGAM GENE, is a viral gene contained in the genome of Vaccinia virus. VGAM17 host target gene, herein designated VGAM HOST TARGET GENE, is a human gene contained in the human genome.

VGAM17 gene, herein designated VGAM GENE, encodes a VGAM17 precursor RNA, herein designated VGAM PRECURSOR RNA. Similar to other miRNA genes, and unlike most ordinary genes, VGAM17 precursor RNA, herein designated VGAM PRECURSOR RNA, does not encode a protein. A nucleotide sequence identical or highly similar to the nucleotide sequence of VGAM17 precursor RNA is designated SEQ ID:3, and is provided hereinbelow with reference to the sequence listing part. Nucleotide sequence SEQ ID:3 is located at position 188927 relative to the genome of Vaccinia virus.

VGAM17 precursor RNA, herein designated VGAM PRECURSOR RNA, folds onto itself, forming VGAM17 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM17 folded precursor RNA, herein designated VGAM FOLDED PRECURSOR RNA, into VGAM17 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM17 RNA is designated SEQ ID:352, and is provided hereinbelow with reference to the sequence listing part.

VGAM17 host target gene, herein designated VGAM HOST TARGET GENE, encodes a corresponding messenger RNA, VGAM17 host target RNA, herein designated VGAM HOST TARGET RNA. VGAM17 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM17 RNA, herein designated VGAM RNA, binds complementarily to one or more host target binding sites located in untranslated regions of VGAM17 host target RNA, herein designated VGAM HOST TARGET RNA. This complementary binding is due to the fact that the nucleotide sequence of VGAM17 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM17 RNA, herein designated VGAM RNA, may have a different number of host target binding sites in untranslated regions of a VGAM17 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM17 RNA, herein designated VGAM RNA, to host target binding sites on VGAM17 host target RNA, herein designated VGAM HOST TARGET RNA, such as BINDING SITE I, BINDING SITE II and BINDING SITE III, inhibits translation of VGAM17 host target RNA, herein designated VGAM HOST TARGET RNA, into VGAM17 host target protein, herein designated VGAM HOST TARGET PROTEIN. VGAM host target protein is therefore outlined by a broken line.

It is appreciated that VGAM17 host target gene, herein designated VGAM HOST TARGET GENE, in fact represents a plurality of VGAM17 host target genes. The mRNA of each one of this plurality of VGAM17 host target genes comprises one or more host target binding sites, each having a nucleotide sequence which is at least partly complementary to VGAM17 RNA, herein designated VGAM RNA, and which when bound by VGAM17 RNA, herein designated VGAM RNA, causes inhibition of translation of respective one or more VGAM17 host target proteins.

It is further appreciated by one skilled in the art that the mode of translational inhibition illustrated by FIG. 1 with specific reference to translational inhibition exerted by VGAM17 gene, herein designated VGAM GENE, on one or more VGAM17 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM17 is inhibition of expression of host target genes, as part of a novel viral mechanism of attacking a host. Accordingly, utilities of VGAM17 include diagnosis, prevention and treatment of viral infection by Vaccinia virus. Specific functions, and accordingly utilities, of VGAM17 correlate with, and may be deduced from, the identity of the host target genes which VGAM17 binds and inhibits, and the function of these host target genes, as elaborated hereinbelow.

Nucleotide sequences of the VGAM17 precursor RNA, herein designated VGAM PRECURSOR RNA, and of the diced VGAM17 RNA, herein designated VGAM RNA, and a schematic representation of the secondary folding of VGAM17 folded precursor RNA, herein designated VGAM FOLDED PRECURSOR RNA, of VGAM17 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM17 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 18 (VGAM18) viral gene, which modulates expression of respective host target genes thereof, the function and utility of which host target genes is known in the art.

VGAM18 is a novel bioinformatically detected regulatory, non protein coding, viral micro RNA (miRNA) gene. The method by which VGAM18 was detected is described hereinabove with reference to FIGS. 2-8.

VGAM18 gene, herein designated VGAM GENE, is a viral gene contained in the genome of Vaccinia virus. VGAM18 host target gene, herein designated VGAM HOST TARGET GENE, is a human gene contained in the human genome.

VGAM18 gene, herein designated VGAM GENE, encodes a VGAM18 precursor RNA, herein designated VGAM PRECURSOR RNA. Similar to other miRNA genes, and unlike most ordinary genes, VGAM18 precursor RNA, herein designated VGAM PRECURSOR RNA, does not encode a protein. A nucleotide sequence identical or highly similar to the nucleotide sequence of VGAM18 precursor RNA is designated SEQ ID:4, and is provided hereinbelow with reference to the sequence listing part. Nucleotide sequence SEQ ID:4 is located at position 188927 relative to the genome of Vaccinia virus.

VGAM18 precursor RNA, herein designated VGAM PRECURSOR RNA, folds onto itself, forming VGAM18 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM18 folded precursor RNA, herein designated VGAM FOLDED PRECURSOR RNA, into VGAM18 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM18 RNA is designated SEQ ID:353, and is provided hereinbelow with reference to the sequence listing part.

VGAM18 host target gene, herein designated VGAM HOST TARGET GENE, encodes a corresponding messenger RNA, VGAM18 host target RNA, herein designated VGAM HOST TARGET RNA. VGAM18 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM18 RNA, herein designated VGAM RNA, binds complementarily to one or more host target binding sites located in untranslated regions of VGAM18 host target RNA, herein designated VGAM HOST TARGET RNA. This complementary binding is due to the fact that the nucleotide sequence of VGAM18 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM18 RNA, herein designated VGAM RNA, may have a different number of host target binding sites in untranslated regions of a VGAM18 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM18 RNA, herein designated VGAM RNA, to host target binding sites on VGAM18 host target RNA, herein designated VGAM HOST TARGET RNA, such as BINDING SITE I, BINDING SITE II and BINDING SITE III, inhibits translation of VGAM18 host target RNA, herein designated VGAM HOST TARGET RNA, into VGAM18 host target protein, herein designated VGAM HOST TARGET PROTEIN. VGAM host target protein is therefore outlined by a broken line.

It is appreciated that VGAM18 host target gene, herein designated VGAM HOST TARGET GENE, in fact represents a plurality of VGAM18 host target genes. The mRNA of each one of this plurality of VGAM18 host target genes comprises one or more host target binding sites, each having a nucleotide sequence which is at least partly complementary to VGAM18 RNA, herein designated VGAM RNA, and which when bound by VGAM18 RNA, herein designated VGAM RNA, causes inhibition of translation of respective one or more VGAM18 host target proteins.

It is further appreciated by one skilled in the art that the mode of translational inhibition illustrated by FIG. 1 with specific reference to translational inhibition exerted by VGAM18 gene, herein designated VGAM GENE, on one or more VGAM18 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM18 is inhibition of expression of host target genes, as part of a novel viral mechanism of attacking a host. Accordingly, utilities of VGAM18 include diagnosis, prevention and treatment of viral infection by Vaccinia virus. Specific functions, and accordingly utilities, of VGAM18 correlate with, and may be deduced from, the identity of the host target genes which VGAM18 binds and inhibits, and the function of these host target genes, as elaborated hereinbelow.

Nucleotide sequences of the VGAM18 precursor RNA, herein designated VGAM PRECURSOR RNA, and of the diced VGAM18 RNA, herein designated VGAM RNA, and a schematic representation of the secondary folding of VGAM18 folded precursor RNA, herein designated VGAM FOLDED PRECURSOR RNA, of VGAM18 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM18 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 19 (VGAM19) viral gene, which modulates expression of respective host target genes thereof, the function and utility of which host target genes is known in the art.

VGAM19 is a novel bioinformatically detected regulatory, non protein coding, viral micro RNA (miRNA) gene. The method by which VGAM19 was detected is described hereinabove with reference to FIGS. 2-8.

VGAM19 gene, herein designated VGAM GENE, is a viral gene contained in the genome of Vaccinia virus. VGAM19 host target gene, herein designated VGAM HOST TARGET GENE, is a human gene contained in the human genome.

VGAM19 gene, herein designated VGAM GENE, encodes a VGAM19 precursor RNA, herein designated VGAM PRECURSOR RNA. Similar to other miRNA genes, and unlike most ordinary genes, VGAM19 precursor RNA, herein designated VGAM PRECURSOR RNA, does not encode a protein. A nucleotide sequence identical or highly similar to the nucleotide sequence of VGAM19 precursor RNA is designated SEQ ID:5, and is provided hereinbelow with reference to the sequence listing part. Nucleotide sequence SEQ ID:5 is located at position 188927 relative to the genome of Vaccinia virus.

VGAM19 precursor RNA, herein designated VGAM PRECURSOR RNA, folds onto itself, forming VGAM19 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM19 folded precursor RNA, herein designated VGAM FOLDED PRECURSOR RNA, into VGAM19 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM19 RNA is designated SEQ ID:354, and is provided hereinbelow with reference to the sequence listing part.

VGAM19 host target gene, herein designated VGAM HOST TARGET GENE, encodes a corresponding messenger RNA, VGAM19 host target RNA, herein designated VGAM HOST TARGET RNA. VGAM19 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM19 RNA, herein designated VGAM RNA, binds complementarily to one or more host target binding sites located in untranslated regions of VGAM19 host target RNA, herein designated VGAM HOST TARGET RNA. This complementary binding is due to the fact that the nucleotide sequence of VGAM19 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM19 RNA, herein designated VGAM RNA, may have a different number of host target binding sites in untranslated regions of a VGAM19 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM19 RNA, herein designated VGAM RNA, to host target binding sites on VGAM19 host target RNA, herein designated VGAM HOST TARGET RNA, such as BINDING SITE I, BINDING SITE II and BINDING SITE III, inhibits translation of VGAM19 host target RNA, herein designated VGAM HOST TARGET RNA, into VGAM19 host target protein, herein designated VGAM HOST TARGET PROTEIN. VGAM host target protein is therefore outlined by a broken line.

It is appreciated that VGAM19 host target gene, herein designated VGAM HOST TARGET GENE, in fact represents a plurality of VGAM19 host target genes. The mRNA of each one of this plurality of VGAM19 host target genes comprises one or more host target binding sites, each having a nucleotide sequence which is at least partly complementary to VGAM19 RNA, herein designated VGAM RNA, and which when bound by VGAM19 RNA, herein designated VGAM RNA, causes inhibition of translation of respective one or more VGAM19 host target proteins.

It is further appreciated by one skilled in the art that the mode of translational inhibition illustrated by FIG. 1 with specific reference to translational inhibition exerted by VGAM19 gene, herein designated VGAM GENE, on one or more VGAM19 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM19 is inhibition of expression of host target genes, as part of a novel viral mechanism of attacking a host. Accordingly, utilities of VGAM19 include diagnosis, prevention and treatment of viral infection by Vaccinia virus. Specific functions, and accordingly utilities, of VGAM19 correlate with, and may be deduced from, the identity of the host target genes which VGAM19 binds and inhibits, and the function of these host target genes, as elaborated hereinbelow.

Nucleotide sequences of the VGAM19 precursor RNA, herein designated VGAM PRECURSOR RNA, and of the diced VGAM19 RNA, herein designated VGAM RNA, and a schematic representation of the secondary folding of VGAM19 folded precursor RNA, herein designated VGAM FOLDED PRECURSOR RNA, of VGAM19 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM19 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 20 (VGAM20) viral gene, which modulates expression of respective host target genes thereof, the function and utility of which host target genes is known in the art.

VGAM20 is a novel bioinformatically detected regulatory, non protein coding, viral micro RNA (miRNA) gene. The method by which VGAM20 was detected is described hereinabove with reference to FIGS. 2-8.

VGAM20 gene, herein designated VGAM GENE, is a viral gene contained in the genome of Vaccinia virus. VGAM20 host target gene, herein designated VGAM HOST TARGET GENE, is a human gene contained in the human genome.

VGAM20 gene, herein designated VGAM GENE, encodes a VGAM20 precursor RNA, herein designated VGAM PRECURSOR RNA. Similar to other miRNA genes, and unlike most ordinary genes, VGAM20 precursor RNA, herein designated VGAM PRECURSOR RNA, does not encode a protein. A nucleotide sequence identical or highly similar to the nucleotide sequence of VGAM20 precursor RNA is designated SEQ ID:6, and is provided hereinbelow with reference to the sequence listing part. Nucleotide sequence SEQ ID:6 is located at position 188927 relative to the genome of Vaccinia virus.

VGAM20 precursor RNA, herein designated VGAM PRECURSOR RNA, folds onto itself, forming VGAM20 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM20 folded precursor RNA, herein designated VGAM FOLDED PRECURSOR RNA, into VGAM20 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM20 RNA is designated SEQ ID:355, and is provided hereinbelow with reference to the sequence listing part.

VGAM20 host target gene, herein designated VGAM HOST TARGET GENE, encodes a corresponding messenger RNA, VGAM20 host target RNA, herein designated VGAM HOST TARGET RNA. VGAM20 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM20 RNA, herein designated VGAM RNA, binds complementarily to one or more host target binding sites located in untranslated regions of VGAM20 host target RNA, herein designated VGAM HOST TARGET RNA. This complementary binding is due to the fact that the nucleotide sequence of VGAM20 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM20 RNA, herein designated VGAM RNA, may have a different number of host target binding sites in untranslated regions of a VGAM20 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM20 RNA, herein designated VGAM RNA, to host target binding sites on VGAM20 host target RNA, herein designated VGAM HOST TARGET RNA, such as BINDING SITE I, BINDING SITE II and BINDING SITE III, inhibits translation of VGAM20 host target RNA, herein designated VGAM HOST TARGET RNA, into VGAM20 host target protein, herein designated VGAM HOST TARGET PROTEIN. VGAM host target protein is therefore outlined by a broken line.

It is appreciated that VGAM20 host target gene, herein designated VGAM HOST TARGET GENE, in fact represents a plurality of VGAM20 host target genes. The mRNA of each one of this plurality of VGAM20 host target genes comprises one or more host target binding sites, each having a nucleotide sequence which is at least partly complementary to VGAM20 RNA, herein designated VGAM RNA, and which when bound by VGAM20 RNA, herein designated VGAM RNA, causes inhibition of translation of respective one or more VGAM20 host target proteins.

It is further appreciated by one skilled in the art that the mode of translational inhibition illustrated by FIG. 1 with specific reference to translational inhibition exerted by VGAM20 gene, herein designated VGAM GENE, on one or more VGAM20 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM20 is inhibition of expression of host target genes, as part of a novel viral mechanism of attacking a host. Accordingly, utilities of VGAM20 include diagnosis, prevention and treatment of viral infection by Vaccinia virus. Specific functions, and accordingly utilities, of VGAM20 correlate with, and may be deduced from, the identity of the host target genes which VGAM20 binds and inhibits, and the function of these host target genes, as elaborated hereinbelow.

Nucleotide sequences of the VGAM20 precursor RNA, herein designated VGAM PRECURSOR RNA, and of the diced VGAM20 RNA, herein designated VGAM RNA, and a schematic representation of the secondary folding of VGAM20 folded precursor RNA, herein designated VGAM FOLDED PRECURSOR RNA, of VGAM20 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM20 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 21 (VGAM21) viral gene, which modulates expression of respective host target genes thereof, the function and utility of which host target genes is known in the art.

VGAM21 is a novel bioinformatically detected regulatory, non protein coding, viral micro RNA (miRNA) gene. The method by which VGAM21 was detected is described hereinabove with reference to FIGS. 2-8.

VGAM21 gene, herein designated VGAM GENE, is a viral gene contained in the genome of Vaccinia virus. VGAM21 host target gene, herein designated VGAM HOST TARGET GENE, is a human gene contained in the human genome.

VGAM21 gene, herein designated VGAM GENE, encodes a VGAM21 precursor RNA, herein designated VGAM PRECURSOR RNA. Similar to other miRNA genes, and unlike most ordinary genes, VGAM21 precursor RNA, herein designated VGAM PRECURSOR RNA, does not encode a protein. A nucleotide sequence identical or highly similar to the nucleotide sequence of VGAM21 precursor RNA is designated SEQ ID:7, and is provided hereinbelow with reference to the sequence listing part. Nucleotide sequence SEQ ID:7 is located at position 188927 relative to the genome of Vaccinia virus.

VGAM21 precursor RNA, herein designated VGAM PRECURSOR RNA, folds onto itself, forming VGAM21 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM21 folded precursor RNA, herein designated VGAM FOLDED PRECURSOR RNA, into VGAM21 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM21 RNA is designated SEQ ID:356, and is provided hereinbelow with reference to the sequence listing part.

VGAM21 host target gene, herein designated VGAM HOST TARGET GENE, encodes a corresponding messenger RNA, VGAM21 host target RNA, herein designated VGAM HOST TARGET RNA. VGAM21 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM21 RNA, herein designated VGAM RNA, binds complementarily to one or more host target binding sites located in untranslated regions of VGAM21 host target RNA, herein designated VGAM HOST TARGET RNA. This complementary binding is due to the fact that the nucleotide sequence of VGAM21 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM21 RNA, herein designated VGAM RNA, may have a different number of host target binding sites in untranslated regions of a VGAM21 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM21 RNA, herein designated VGAM RNA, to host target binding sites on VGAM21 host target RNA, herein designated VGAM HOST TARGET RNA, such as BINDING SITE I, BINDING SITE II and BINDING SITE III, inhibits translation of VGAM21 host target RNA, herein designated VGAM HOST TARGET RNA, into VGAM21 host target protein, herein designated VGAM HOST TARGET PROTEIN. VGAM host target protein is therefore outlined by a broken line.

It is appreciated that VGAM21 host target gene, herein designated VGAM HOST TARGET GENE, in fact represents a plurality of VGAM21 host target genes. The mRNA of each one of this plurality of VGAM21 host target genes comprises one or more host target binding sites, each having a nucleotide sequence which is at least partly complementary to VGAM21 RNA, herein designated VGAM RNA, and which when bound by VGAM21 RNA, herein designated VGAM RNA, causes inhibition of translation of respective one or more VGAM21 host target proteins.

It is further appreciated by one skilled in the art that the mode of translational inhibition illustrated by FIG. 1 with specific reference to translational inhibition exerted by VGAM21 gene, herein designated VGAM GENE, on one or more VGAM21 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM21 is inhibition of expression of host target genes, as part of a novel viral mechanism of attacking a host. Accordingly, utilities of VGAM21 include diagnosis, prevention and treatment of viral infection by Vaccinia virus. Specific functions, and accordingly utilities, of VGAM21 correlate with, and may be deduced from, the identity of the host target genes which VGAM21 binds and inhibits, and the function of these host target genes, as elaborated hereinbelow.

Nucleotide sequences of the VGAM21 precursor RNA, herein designated VGAM PRECURSOR RNA, and of the diced VGAM21 RNA, herein designated VGAM RNA, and a schematic representation of the secondary folding of VGAM21 folded precursor RNA, herein designated VGAM FOLDED PRECURSOR RNA, of VGAM21 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM21 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 22 (VGAM22) viral gene, which modulates expression of respective host target genes thereof, the function and utility of which host target genes is known in the art.

VGAM22 is a novel bioinformatically detected regulatory, non protein coding, viral micro RNA (miRNA) gene. The method by which VGAM22 was detected is described hereinabove with reference to FIGS. 2-8.

VGAM22 gene, herein designated VGAM GENE, is a viral gene contained in the genome of Vaccinia virus. VGAM22 host target gene, herein designated VGAM HOST TARGET GENE, is a human gene contained in the human genome.

VGAM22 gene, herein designated VGAM GENE, encodes a VGAM22 precursor RNA, herein designated VGAM PRECURSOR RNA. Similar to other miRNA genes, and unlike most ordinary genes, VGAM22 precursor RNA, herein designated VGAM PRECURSOR RNA, does not encode a protein. A nucleotide sequence identical or highly similar to the nucleotide sequence of VGAM22 precursor RNA is designated SEQ ID:8, and is provided hereinbelow with reference to the sequence listing part. Nucleotide sequence SEQ ID:8 is located at position 188927 relative to the genome of Vaccinia virus.

VGAM22 precursor RNA, herein designated VGAM PRECURSOR RNA, folds onto itself, forming VGAM22 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM22 folded precursor RNA, herein designated VGAM FOLDED PRECURSOR RNA, into VGAM22 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM22 RNA is designated SEQ ID:357, and is provided hereinbelow with reference to the sequence listing part.

VGAM22 host target gene, herein designated VGAM HOST TARGET GENE, encodes a corresponding messenger RNA, VGAM22 host target RNA, herein designated VGAM HOST TARGET RNA. VGAM22 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM22 RNA, herein designated VGAM RNA, binds complementarily to one or more host target binding sites located in untranslated regions of VGAM22 host target RNA, herein designated VGAM HOST TARGET RNA. This complementary binding is due to the fact that the nucleotide sequence of VGAM22 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM22 RNA, herein designated VGAM RNA, may have a different number of host target binding sites in untranslated regions of a VGAM22 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM22 RNA, herein designated VGAM RNA, to host target binding sites on VGAM22 host target RNA, herein designated VGAM HOST TARGET RNA, such as BINDING SITE I, BINDING SITE II and BINDING SITE III, inhibits translation of VGAM22 host target RNA, herein designated VGAM HOST TARGET RNA, into VGAM22 host target protein, herein designated VGAM HOST TARGET PROTEIN. VGAM host target protein is therefore outlined by a broken line.

It is appreciated that VGAM22 host target gene, herein designated VGAM HOST TARGET GENE, in fact represents a plurality of VGAM22 host target genes. The mRNA of each one of this plurality of VGAM22 host target genes comprises one or more host target binding sites, each having a nucleotide sequence which is at least partly complementary to VGAM22 RNA, herein designated VGAM RNA, and which when bound by VGAM22 RNA, herein designated VGAM RNA, causes inhibition of translation of respective one or more VGAM22 host target proteins.

It is further appreciated by one skilled in the art that the mode of translational inhibition illustrated by FIG. 1 with specific reference to translational inhibition exerted by VGAM22 gene, herein designated VGAM GENE, on one or more VGAM22 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM22 is inhibition of expression of host target genes, as part of a novel viral mechanism of attacking a host. Accordingly, utilities of VGAM22 include diagnosis, prevention and treatment of viral infection by Vaccinia virus. Specific functions, and accordingly utilities, of VGAM22 correlate with, and may be deduced from, the identity of the host target genes which VGAM22 binds and inhibits, and the function of these host target genes, as elaborated hereinbelow.

Nucleotide sequences of the VGAM22 precursor RNA, herein designated VGAM PRECURSOR RNA, and of the diced VGAM22 RNA, herein designated VGAM RNA, and a schematic representation of the secondary folding of VGAM22 folded precursor RNA, herein designated VGAM FOLDED PRECURSOR RNA, of VGAM22 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM22 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 23 (VGAM23) viral gene, which modulates expression of respective host target genes thereof, the function and utility of which host target genes is known in the art.

VGAM23 is a novel bioinformatically detected regulatory, non protein coding, viral micro RNA (miRNA) gene. The method by which VGAM23 was detected is described hereinabove with reference to FIGS. 2-8.

VGAM23 gene, herein designated VGAM GENE, is a viral gene contained in the genome of Vaccinia virus. VGAM23 host target gene, herein designated VGAM HOST TARGET GENE, is a human gene contained in the human genome.

VGAM23 gene, herein designated VGAM GENE, encodes a VGAM23 precursor RNA, herein designated VGAM PRECURSOR RNA. Similar to other miRNA genes, and unlike most ordinary genes, VGAM23 precursor RNA, herein designated VGAM PRECURSOR RNA, does not encode a protein. A nucleotide sequence identical or highly similar to the nucleotide sequence of VGAM23 precursor RNA is designated SEQ ID:9, and is provided hereinbelow with reference to the sequence listing part. Nucleotide sequence SEQ ID:9 is located at position 188927 relative to the genome of Vaccinia virus.

VGAM23 precursor RNA, herein designated VGAM PRECURSOR RNA, folds onto itself, forming VGAM23 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM23 folded precursor RNA, herein designated VGAM FOLDED PRECURSOR RNA, into VGAM23 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM23 RNA is designated SEQ ID:358, and is provided hereinbelow with reference to the sequence listing part.

VGAM23 host target gene, herein designated VGAM HOST TARGET GENE, encodes a corresponding messenger RNA, VGAM23 host target RNA, herein designated VGAM HOST TARGET RNA. VGAM23 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM23 RNA, herein designated VGAM RNA, binds complementarily to one or more host target binding sites located in untranslated regions of VGAM23 host target RNA, herein designated VGAM HOST TARGET RNA. This complementary binding is due to the fact that the nucleotide sequence of VGAM23 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM23 RNA, herein designated VGAM RNA, may have a different number of host target binding sites in untranslated regions of a VGAM23 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM23 RNA, herein designated VGAM RNA, to host target binding sites on VGAM23 host target RNA, herein designated VGAM HOST TARGET RNA, such as BINDING SITE I, BINDING SITE II and BINDING SITE III, inhibits translation of VGAM23 host target RNA, herein designated VGAM HOST TARGET RNA, into VGAM23 host target protein, herein designated VGAM HOST TARGET PROTEIN. VGAM host target protein is therefore outlined by a broken line.

It is appreciated that VGAM23 host target gene, herein designated VGAM HOST TARGET GENE, in fact represents a plurality of VGAM23 host target genes. The mRNA of each one of this plurality of VGAM23 host target genes comprises one or more host target binding sites, each having a nucleotide sequence which is at least partly complementary to VGAM23 RNA, herein designated VGAM RNA, and which when bound by VGAM23 RNA, herein designated VGAM RNA, causes inhibition of translation of respective one or more VGAM23 host target proteins.

It is further appreciated by one skilled in the art that the mode of translational inhibition illustrated by FIG. 1 with specific reference to translational inhibition exerted by VGAM23 gene, herein designated VGAM GENE, on one or more VGAM23 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM23 is inhibition of expression of host target genes, as part of a novel viral mechanism of attacking a host. Accordingly, utilities of VGAM23 include diagnosis, prevention and treatment of viral infection by Vaccinia virus. Specific functions, and accordingly utilities, of VGAM23 correlate with, and may be deduced from, the identity of the host target genes which VGAM23 binds and inhibits, and the function of these host target genes, as elaborated hereinbelow.

Nucleotide sequences of the VGAM23 precursor RNA, herein designated VGAM PRECURSOR RNA, and of the diced VGAM23 RNA, herein designated VGAM RNA, and a schematic representation of the secondary folding of VGAM23 folded precursor RNA, herein designated VGAM FOLDED PRECURSOR RNA, of VGAM23 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM23 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 24 (VGAM24) viral gene, which modulates expression of respective host target genes thereof, the function and utility of which host target genes is known in the art.

VGAM24 is a novel bioinformatically detected regulatory, non protein coding, viral micro RNA (miRNA) gene. The method by which VGAM24 was detected is described hereinabove with reference to FIGS. 2-8.

VGAM24 gene, herein designated VGAM GENE, is a viral gene contained in the genome of Vaccinia virus. VGAM24 host target gene, herein designated VGAM HOST TARGET GENE, is a human gene contained in the human genome.

VGAM24 gene, herein designated VGAM GENE, encodes a VGAM24 precursor RNA, herein designated VGAM PRECURSOR RNA. Similar to other miRNA genes, and unlike most ordinary genes, VGAM24 precursor RNA, herein designated VGAM PRECURSOR RNA, does not encode a protein. A nucleotide sequence identical or highly similar to the nucleotide sequence of VGAM24 precursor RNA is designated SEQ ID:10, and is provided hereinbelow with reference to the sequence listing part. Nucleotide sequence SEQ ID: 10 is located at position 188927 relative to the genome of Vaccinia virus.

VGAM24 precursor RNA, herein designated VGAM PRECURSOR RNA, folds onto itself, forming VGAM24 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM24 folded precursor RNA, herein designated VGAM FOLDED PRECURSOR RNA, into VGAM24 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM24 RNA is designated SEQ ID:359, and is provided hereinbelow with reference to the sequence listing part.

VGAM24 host target gene, herein designated VGAM HOST TARGET GENE, encodes a corresponding messenger RNA, VGAM24 host target RNA, herein designated VGAM HOST TARGET RNA. VGAM24 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM24 RNA, herein designated VGAM RNA, binds complementarily to one or more host target binding sites located in untranslated regions of VGAM24 host target RNA, herein designated VGAM HOST TARGET RNA. This complementary binding is due to the fact that the nucleotide sequence of VGAM24 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM24 RNA, herein designated VGAM RNA, may have a different number of host target binding sites in untranslated regions of a VGAM24 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM24 RNA, herein designated VGAM RNA, to host target binding sites on VGAM24 host target RNA, herein designated VGAM HOST TARGET RNA, such as BINDING SITE I, BINDING SITE II and BINDING SITE III, inhibits translation of VGAM24 host target RNA, herein designated VGAM HOST TARGET RNA, into VGAM24 host target protein, herein designated VGAM HOST TARGET PROTEIN. VGAM host target protein is therefore outlined by a broken line.

It is appreciated that VGAM24 host target gene, herein designated VGAM HOST TARGET GENE, in fact represents a plurality of VGAM24 host target genes. The mRNA of each one of this plurality of VGAM24 host target genes comprises one or more host target binding sites, each having a nucleotide sequence which is at least partly complementary to VGAM24 RNA, herein designated VGAM RNA, and which when bound by VGAM24 RNA, herein designated VGAM RNA, causes inhibition of translation of respective one or more VGAM24 host target proteins.

It is further appreciated by one skilled in the art that the mode of translational inhibition illustrated by FIG. 1 with specific reference to translational inhibition exerted by VGAM24 gene, herein designated VGAM GENE, on one or more VGAM24 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM24 is inhibition of expression of host target genes, as part of a novel viral mechanism of attacking a host. Accordingly, utilities of VGAM24 include diagnosis, prevention and treatment of viral infection by Vaccinia virus. Specific functions, and accordingly utilities, of VGAM24 correlate with, and may be deduced from, the identity of the host target genes which VGAM24 binds and inhibits, and the function of these host target genes, as elaborated hereinbelow.

Nucleotide sequences of the VGAM24 precursor RNA, herein designated VGAM PRECURSOR RNA, and of the diced VGAM24 RNA, herein designated VGAM RNA, and a schematic representation of the secondary folding of VGAM24 folded precursor RNA, herein designated VGAM FOLDED PRECURSOR RNA, of VGAM24 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM24 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 25 (VGAM25) viral gene, which modulates expression of respective host target genes thereof, the function and utility of which host target genes is known in the art.

VGAM25 is a novel bioinformatically detected regulatory, non protein coding, viral micro RNA (miRNA) gene. The method by which VGAM25 was detected is described hereinabove with reference to FIGS. 2-8.

VGAM25 gene, herein designated VGAM GENE, is a viral gene contained in the genome of Vaccinia virus. VGAM25 host target gene, herein designated VGAM HOST TARGET GENE, is a human gene contained in the human genome.

VGAM25 gene, herein designated VGAM GENE, encodes a VGAM25 precursor RNA, herein designated VGAM PRECURSOR RNA. Similar to other miRNA genes, and unlike most ordinary genes, VGAM25 precursor RNA, herein designated VGAM PRECURSOR RNA, does not encode a protein. A nucleotide sequence identical or highly similar to the nucleotide sequence of VGAM25 precursor RNA is designated SEQ ID:11, and is provided hereinbelow with reference to the sequence listing part. Nucleotide sequence SEQ ID:11 is located at position 188927 relative to the genome of Vaccinia virus.

VGAM25 precursor RNA, herein designated VGAM PRECURSOR RNA, folds onto itself, forming VGAM25 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM25 folded precursor RNA, herein designated VGAM FOLDED PRECURSOR RNA, into VGAM25 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM25 RNA is designated SEQ ID:360, and is provided hereinbelow with reference to the sequence listing part.

VGAM25 host target gene, herein designated VGAM HOST TARGET GENE, encodes a corresponding messenger RNA, VGAM25 host target RNA, herein designated VGAM HOST TARGET RNA. VGAM25 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM25 RNA, herein designated VGAM RNA, binds complementarily to one or more host target binding sites located in untranslated regions of VGAM25 host target RNA, herein designated VGAM HOST TARGET RNA. This complementary binding is due to the fact that the nucleotide sequence of VGAM25 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM25 RNA, herein designated VGAM RNA, may have a different number of host target binding sites in untranslated regions of a VGAM25 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM25 RNA, herein designated VGAM RNA, to host target binding sites on VGAM25 host target RNA, herein designated VGAM HOST TARGET RNA, such as BINDING SITE I, BINDING SITE II and BINDING SITE III, inhibits translation of VGAM25 host target RNA, herein designated VGAM HOST TARGET RNA, into VGAM25 host target protein, herein designated VGAM HOST TARGET PROTEIN. VGAM host target protein is therefore outlined by a broken line.

It is appreciated that VGAM25 host target gene, herein designated VGAM HOST TARGET GENE, in fact represents a plurality of VGAM25 host target genes. The mRNA of each one of this plurality of VGAM25 host target genes comprises one or more host target binding sites, each having a nucleotide sequence which is at least partly complementary to VGAM25 RNA, herein designated VGAM RNA, and which when bound by VGAM25 RNA, herein designated VGAM RNA, causes inhibition of translation of respective one or more VGAM25 host target proteins.

It is further appreciated by one skilled in the art that the mode of translational inhibition illustrated by FIG. 1 with specific reference to translational inhibition exerted by VGAM25 gene, herein designated VGAM GENE, on one or more VGAM25 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM25 is inhibition of expression of host target genes, as part of a novel viral mechanism of attacking a host. Accordingly, utilities of VGAM25 include diagnosis, prevention and treatment of viral infection by Vaccinia virus. Specific functions, and accordingly utilities, of VGAM25 correlate with, and may be deduced from, the identity of the host target genes which VGAM25 binds and inhibits, and the function of these host target genes, as elaborated hereinbelow.

Nucleotide sequences of the VGAM25 precursor RNA, herein designated VGAM PRECURSOR RNA, and of the diced VGAM25 RNA, herein designated VGAM RNA, and a schematic representation of the secondary folding of VGAM25 folded precursor RNA, herein designated VGAM FOLDED PRECURSOR RNA, of VGAM25 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM25 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 26 (VGAM26) viral gene, which modulates expression of respective host target genes thereof, the function and utility of which host target genes is known in the art.

VGAM26 is a novel bioinformatically detected regulatory, non protein coding, viral micro RNA (miRNA) gene. The method by which VGAM26 was detected is described hereinabove with reference to FIGS. 2-8.

VGAM26 gene, herein designated VGAM GENE, is a viral gene contained in the genome of Vaccinia virus. VGAM26 host target gene, herein designated VGAM HOST TARGET GENE, is a human gene contained in the human genome.

VGAM26 gene, herein designated VGAM GENE, encodes a VGAM26 precursor RNA, herein designated VGAM PRECURSOR RNA. Similar to other miRNA genes, and unlike most ordinary genes, VGAM26 precursor RNA, herein designated VGAM PRECURSOR RNA, does not encode a protein. A nucleotide sequence identical or highly similar to the nucleotide sequence of VGAM26 precursor RNA is designated SEQ ID:12, and is provided hereinbelow with reference to the sequence listing part. Nucleotide sequence SEQ ID:12 is located at position 189067 relative to the genome of Vaccinia virus.

VGAM26 precursor RNA, herein designated VGAM PRECURSOR RNA, folds onto itself, forming VGAM26 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM26 folded precursor RNA, herein designated VGAM FOLDED PRECURSOR RNA, into VGAM26 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 78%) nucleotide sequence of VGAM26 RNA is designated SEQ ID:361, and is provided hereinbelow with reference to the sequence listing part.

VGAM26 host target gene, herein designated VGAM HOST TARGET GENE, encodes a corresponding messenger RNA, VGAM26 host target RNA, herein designated VGAM HOST TARGET RNA. VGAM26 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM26 RNA, herein designated VGAM RNA, binds complementarily to one or more host target binding sites located in untranslated regions of VGAM26 host target RNA, herein designated VGAM HOST TARGET RNA. This complementary binding is due to the fact that the nucleotide sequence of VGAM26 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM26 RNA, herein designated VGAM RNA, may have a different number of host target binding sites in untranslated regions of a VGAM26 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM26 RNA, herein designated VGAM RNA, to host target binding sites on VGAM26 host target RNA, herein designated VGAM HOST TARGET RNA, such as BINDING SITE I, BINDING SITE II and BINDING SITE III, inhibits translation of VGAM26 host target RNA, herein designated VGAM HOST TARGET RNA, into VGAM26 host target protein, herein designated VGAM HOST TARGET PROTEIN. VGAM host target protein is therefore outlined by a broken line.

It is appreciated that VGAM26 host target gene, herein designated VGAM HOST TARGET GENE, in fact represents a plurality of VGAM26 host target genes. The mRNA of each one of this plurality of VGAM26 host target genes comprises one or more host target binding sites, each having a nucleotide sequence which is at least partly complementary to VGAM26 RNA, herein designated VGAM RNA, and which when bound by VGAM26 RNA, herein designated VGAM RNA, causes inhibition of translation of respective one or more VGAM26 host target proteins.

It is further appreciated by one skilled in the art that the mode of translational inhibition illustrated by FIG. 1 with specific reference to translational inhibition exerted by VGAM26 gene, herein designated VGAM GENE, on one or more VGAM26 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM26 is inhibition of expression of host target genes, as part of a novel viral mechanism of attacking a host. Accordingly, utilities of VGAM26 include diagnosis, prevention and treatment of viral infection by Vaccinia virus. Specific functions, and accordingly utilities, of VGAM26 correlate with, and may be deduced from, the identity of the host target genes which VGAM26 binds and inhibits, and the function of these host target genes, as elaborated hereinbelow.

Nucleotide sequences of the VGAM26 precursor RNA, herein designated VGAM PRECURSOR RNA, and of the diced VGAM26 RNA, herein designated VGAM RNA, and a schematic representation of the secondary folding of VGAM26 folded precursor RNA, herein designated VGAM FOLDED PRECURSOR RNA, of VGAM26 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM26 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 27 (VGAM27) viral gene, which modulates expression of respective host target genes thereof, the function and utility of which host target genes is known in the art.

VGAM27 is a novel bioinformatically detected regulatory, non protein coding, viral micro RNA (miRNA) gene. The method by which VGAM27 was detected is described hereinabove with reference to FIGS. 2-8.

VGAM27 gene, herein designated VGAM GENE, is a viral gene contained in the genome of Vaccinia virus. VGAM27 host target gene, herein designated VGAM HOST TARGET GENE, is a human gene contained in the human genome.

VGAM27 gene, herein designated VGAM GENE, encodes a VGAM27 precursor RNA, herein designated VGAM PRECURSOR RNA. Similar to other miRNA genes, and unlike most ordinary genes, VGAM27 precursor RNA, herein designated VGAM PRECURSOR RNA, does not encode a protein. A nucleotide sequence identical or highly similar to the nucleotide sequence of VGAM27 precursor RNA is designated SEQ ID:13, and is provided hereinbelow with reference to the sequence listing part. Nucleotide sequence SEQ ID:13 is located at position 190758 relative to the genome of Vaccinia virus.

VGAM27 precursor RNA, herein designated VGAM PRECURSOR RNA, folds onto itself, forming VGAM27 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM27 folded precursor RNA, herein designated VGAM FOLDED PRECURSOR RNA, into VGAM27 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM27 RNA is designated SEQ ID:362, and is provided hereinbelow with reference to the sequence listing part.

VGAM27 host target gene, herein designated VGAM HOST TARGET GENE, encodes a corresponding messenger RNA, VGAM27 host target RNA, herein designated VGAM HOST TARGET RNA. VGAM27 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM27 RNA, herein designated VGAM RNA, binds complementarily to one or more host target binding sites located in untranslated regions of VGAM27 host target RNA, herein designated VGAM HOST TARGET RNA. This complementary binding is due to the fact that the nucleotide sequence of VGAM27 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM27 RNA, herein designated VGAM RNA, may have a different number of host target binding sites in untranslated regions of a VGAM27 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM27 RNA, herein designated VGAM RNA, to host target binding sites on VGAM27 host target RNA, herein designated VGAM HOST TARGET RNA, such as BINDING SITE I, BINDING SITE II and BINDING SITE III, inhibits translation of VGAM27 host target RNA, herein designated VGAM HOST TARGET RNA, into VGAM27 host target protein, herein designated VGAM HOST TARGET PROTEIN. VGAM host target protein is therefore outlined by a broken line.

It is appreciated that VGAM27 host target gene, herein designated VGAM HOST TARGET GENE, in fact represents a plurality of VGAM27 host target genes. The mRNA of each one of this plurality of VGAM27 host target genes comprises one or more host target binding sites, each having a nucleotide sequence which is at least partly complementary to VGAM27 RNA, herein designated VGAM RNA, and which when bound by VGAM27 RNA, herein designated VGAM RNA, causes inhibition of translation of respective one or more VGAM27 host target proteins.

It is further appreciated by one skilled in the art that the mode of translational inhibition illustrated by FIG. 1 with specific reference to translational inhibition exerted by VGAM27 gene, herein designated VGAM GENE, on one or more VGAM27 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM27 is inhibition of expression of host target genes, as part of a novel viral mechanism of attacking a host. Accordingly, utilities of VGAM27 include diagnosis, prevention and treatment of viral infection by Vaccinia virus. Specific functions, and accordingly utilities, of VGAM27 correlate with, and may be deduced from, the identity of the host target genes which VGAM27 binds and inhibits, and the function of these host target genes, as elaborated hereinbelow.

Nucleotide sequences of the VGAM27 precursor RNA, herein designated VGAM PRECURSOR RNA, and of the diced VGAM27 RNA, herein designated VGAM RNA, and a schematic representation of the secondary folding of VGAM27 folded precursor RNA, herein designated VGAM FOLDED PRECURSOR RNA, of VGAM27 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM27 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 28 (VGAM28) viral gene, which modulates expression of respective host target genes thereof, the function and utility of which host target genes is known in the art.

VGAM28 is a novel bioinformatically detected regulatory, non protein coding, viral micro RNA (miRNA) gene. The method by which VGAM28 was detected is described hereinabove with reference to FIGS. 2-8.

VGAM28 gene, herein designated VGAM GENE, is a viral gene contained in the genome of Vaccinia virus. VGAM28 host target gene, herein designated VGAM HOST TARGET GENE, is a human gene contained in the human genome.

VGAM28 gene, herein designated VGAM GENE, encodes a VGAM28 precursor RNA, herein designated VGAM PRECURSOR RNA. Similar to other miRNA genes, and unlike most ordinary genes, VGAM28 precursor RNA, herein designated VGAM PRECURSOR RNA, does not encode a protein. A nucleotide sequence identical or highly similar to the nucleotide sequence of VGAM28 precursor RNA is designated SEQ ID:14, and is provided hereinbelow with reference to the sequence listing part. Nucleotide sequence SEQ ID: 14 is located at position 190758 relative to the genome of Vaccinia virus.

VGAM28 precursor RNA, herein designated VGAM PRECURSOR RNA, folds onto itself, forming VGAM28 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM28 folded precursor RNA, herein designated VGAM FOLDED PRECURSOR RNA, into VGAM28 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM28 RNA is designated SEQ ID:363, and is provided hereinbelow with reference to the sequence listing part.

VGAM28 host target gene, herein designated VGAM HOST TARGET GENE, encodes a corresponding messenger RNA, VGAM28 host target RNA, herein designated VGAM HOST TARGET RNA. VGAM28 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM28 RNA, herein designated VGAM RNA, binds complementarily to one or more host target binding sites located in untranslated regions of VGAM28 host target RNA, herein designated VGAM HOST TARGET RNA. This complementary binding is due to the fact that the nucleotide sequence of VGAM28 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM28 RNA, herein designated VGAM RNA, may have a different number of host target binding sites in untranslated regions of a VGAM28 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM28 RNA, herein designated VGAM RNA, to host target binding sites on VGAM28 host target RNA, herein designated VGAM HOST TARGET RNA, such as BINDING SITE I, BINDING SITE II and BINDING SITE III, inhibits translation of VGAM28 host target RNA, herein designated VGAM HOST TARGET RNA, into VGAM28 host target protein, herein designated VGAM HOST TARGET PROTEIN. VGAM host target protein is therefore outlined by a broken line.

It is appreciated that VGAM28 host target gene, herein designated VGAM HOST TARGET GENE, in fact represents a plurality of VGAM28 host target genes. The mRNA of each one of this plurality of VGAM28 host target genes comprises one or more host target binding sites, each having a nucleotide sequence which is at least partly complementary to VGAM28 RNA, herein designated VGAM RNA, and which when bound by VGAM28 RNA, herein designated VGAM RNA, causes inhibition of translation of respective one or more VGAM28 host target proteins.

It is further appreciated by one skilled in the art that the mode of translational inhibition illustrated by FIG. 1 with specific reference to translational inhibition exerted by VGAM28 gene, herein designated VGAM GENE, on one or more VGAM28 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM28 is inhibition of expression of host target genes, as part of a novel viral mechanism of attacking a host. Accordingly, utilities of VGAM28 include diagnosis, prevention and treatment of viral infection by Vaccinia virus. Specific functions, and accordingly utilities, of VGAM28 correlate with, and may be deduced from, the identity of the host target genes which VGAM28 binds and inhibits, and the function of these host target genes, as elaborated hereinbelow.

Nucleotide sequences of the VGAM28 precursor RNA, herein designated VGAM PRECURSOR RNA, and of the diced VGAM28 RNA, herein designated VGAM RNA, and a schematic representation of the secondary folding of VGAM28 folded precursor RNA, herein designated VGAM FOLDED PRECURSOR RNA, of VGAM28 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM28 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 29 (VGAM29) viral gene, which modulates expression of respective host target genes thereof, the function and utility of which host target genes is known in the art.

VGAM29 is a novel bioinformatically detected regulatory, non protein coding, viral micro RNA (miRNA) gene. The method by which VGAM29 was detected is described hereinabove with reference to FIGS. 2-8.

VGAM29 gene, herein designated VGAM GENE, is a viral gene contained in the genome of Vaccinia virus. VGAM29 host target gene, herein designated VGAM HOST TARGET GENE, is a human gene contained in the human genome.

VGAM29 gene, herein designated VGAM GENE, encodes a VGAM29 precursor RNA, herein designated VGAM PRECURSOR RNA. Similar to other miRNA genes, and unlike most ordinary genes, VGAM29 precursor RNA, herein designated VGAM PRECURSOR RNA, does not encode a protein. A nucleotide sequence identical or highly similar to the nucleotide sequence of VGAM29 precursor RNA is designated SEQ ID:15, and is provided hereinbelow with reference to the sequence listing part. Nucleotide sequence SEQ ID:15 is located at position 188937 relative to the genome of Vaccinia virus.

VGAM29 precursor RNA, herein designated VGAM PRECURSOR RNA, folds onto itself, forming VGAM29 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM29 folded precursor RNA, herein designated VGAM FOLDED PRECURSOR RNA, into VGAM29 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 77%) nucleotide sequence of VGAM29 RNA is designated SEQ ID:364, and is provided hereinbelow with reference to the sequence listing part.

VGAM29 host target gene, herein designated VGAM HOST TARGET GENE, encodes a corresponding messenger RNA, VGAM29 host target RNA, herein designated VGAM HOST TARGET RNA. VGAM29 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM29 RNA, herein designated VGAM RNA, binds complementarily to one or more host target binding sites located in untranslated regions of VGAM29 host target RNA, herein designated VGAM HOST TARGET RNA. This complementary binding is due to the fact that the nucleotide sequence of VGAM29 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM29 RNA, herein designated VGAM RNA, may have a different number of host target binding sites in untranslated regions of a VGAM29 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM29 RNA, herein designated VGAM RNA, to host target binding sites on VGAM29 host target RNA, herein designated VGAM HOST TARGET RNA, such as BINDING SITE I, BINDING SITE II and BINDING SITE III, inhibits translation of VGAM29 host target RNA, herein designated VGAM HOST TARGET RNA, into VGAM29 host target protein, herein designated VGAM HOST TARGET PROTEIN. VGAM host target protein is therefore outlined by a broken line.

It is appreciated that VGAM29 host target gene, herein designated VGAM HOST TARGET GENE, in fact represents a plurality of VGAM29 host target genes. The mRNA of each one of this plurality of VGAM29 host target genes comprises one or more host target binding sites, each having a nucleotide sequence which is at least partly complementary to VGAM29 RNA, herein designated VGAM RNA, and which when bound by VGAM29 RNA, herein designated VGAM RNA, causes inhibition of translation of respective one or more VGAM29 host target proteins.

It is further appreciated by one skilled in the art that the mode of translational inhibition illustrated by FIG. 1 with specific reference to translational inhibition exerted by VGAM29 gene, herein designated VGAM GENE, on one or more VGAM29 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM29 is inhibition of expression of host target genes, as part of a novel viral mechanism of attacking a host. Accordingly, utilities of VGAM29 include diagnosis, prevention and treatment of viral infection by Vaccinia virus. Specific functions, and accordingly utilities, of VGAM29 correlate with, and may be deduced from, the identity of the host target genes which VGAM29 binds and inhibits, and the function of these host target genes, as elaborated hereinbelow.

Nucleotide sequences of the VGAM29 precursor RNA, herein designated VGAM PRECURSOR RNA, and of the diced VGAM29 RNA, herein designated VGAM RNA, and a schematic representation of the secondary folding of VGAM29 folded precursor RNA, herein designated VGAM FOLDED PRECURSOR RNA, of VGAM29 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM29 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 30 (VGAM30) viral gene, which modulates expression of respective host target genes thereof, the function and utility of which host target genes is known in the art.

VGAM30 is a novel bioinformatically detected regulatory, non protein coding, viral micro RNA (miRNA) gene. The method by which VGAM30 was detected is described hereinabove with reference to FIGS. 2-8.

VGAM30 gene, herein designated VGAM GENE, is a viral gene contained in the genome of Vaccinia virus. VGAM30 host target gene, herein designated VGAM HOST TARGET GENE, is a human gene contained in the human genome.

VGAM30 gene, herein designated VGAM GENE, encodes a VGAM30 precursor RNA, herein designated VGAM PRECURSOR RNA. Similar to other miRNA genes, and unlike most ordinary genes, VGAM30 precursor RNA, herein designated VGAM PRECURSOR RNA, does not encode a protein. A nucleotide sequence identical or highly similar to the nucleotide sequence of VGAM30 precursor RNA is designated SEQ ID:16, and is provided hereinbelow with reference to the sequence listing part. Nucleotide sequence SEQ ID: 16 is located at position 187719 relative to the genome of Vaccinia virus.

VGAM30 precursor RNA, herein designated VGAM PRECURSOR RNA, folds onto itself, forming VGAM30 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM30 folded precursor RNA, herein designated VGAM FOLDED PRECURSOR RNA, into VGAM30 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 88%) nucleotide sequence of VGAM30 RNA is designated SEQ ID:365, and is provided hereinbelow with reference to the sequence listing part.

VGAM30 host target gene, herein designated VGAM HOST TARGET GENE, encodes a corresponding messenger RNA, VGAM30 host target RNA, herein designated VGAM HOST TARGET RNA. VGAM30 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM30 RNA, herein designated VGAM RNA, binds complementarily to one or more host target binding sites located in untranslated regions of VGAM30 host target RNA, herein designated VGAM HOST TARGET RNA. This complementary binding is due to the fact that the nucleotide sequence of VGAM30 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM30 RNA, herein designated VGAM RNA, may have a different number of host target binding sites in untranslated regions of a VGAM30 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM30 RNA, herein designated VGAM RNA, to host target binding sites on VGAM30 host target RNA, herein designated VGAM HOST TARGET RNA, such as BINDING SITE I, BINDING SITE II and BINDING SITE III, inhibits translation of VGAM30 host target RNA, herein designated VGAM HOST TARGET RNA, into VGAM30 host target protein, herein designated VGAM HOST TARGET PROTEIN. VGAM host target protein is therefore outlined by a broken line.

It is appreciated that VGAM30 host target gene, herein designated VGAM HOST TARGET GENE, in fact represents a plurality of VGAM30 host target genes. The mRNA of each one of this plurality of VGAM30 host target genes comprises one or more host target binding sites, each having a nucleotide sequence which is at least partly complementary to VGAM30 RNA, herein designated VGAM RNA, and which when bound by VGAM30 RNA, herein designated VGAM RNA, causes inhibition of translation of respective one or more VGAM30 host target proteins.

It is further appreciated by one skilled in the art that the mode of translational inhibition illustrated by FIG. 1 with specific reference to translational inhibition exerted by VGAM30 gene, herein designated VGAM GENE, on one or more VGAM30 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM30 is inhibition of expression of host target genes, as part of a novel viral mechanism of attacking a host. Accordingly, utilities of VGAM30 include diagnosis, prevention and treatment of viral infection by Vaccinia virus. Specific functions, and accordingly utilities of VGAM30 correlate with, and may be deduced from, the identity of the host target genes which VGAM30 binds and inhibits, and the function of these host target genes, as elaborated hereinbelow.

Nucleotide sequences of the VGAM30 precursor RNA, herein designated VGAM PRECURSOR RNA, and of the diced VGAM30 RNA, herein designated VGAM RNA, and a schematic representation of the secondary folding of VGAM30 folded precursor RNA, herein designated VGAM FOLDED PRECURSOR RNA, of VGAM30 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM30 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 31 (VGAM31) viral gene, which modulates expression of respective host target genes thereof, the function and utility of which host target genes is known in the art.

VGAM31 is a novel bioinformatically detected regulatory, non protein coding, viral micro RNA (miRNA) gene. The method by which VGAM31 was detected is described hereinabove with reference to FIGS. 2-8.

VGAM31 gene, herein designated VGAM GENE, is a viral gene contained in the genome of Vaccinia virus. VGAM31 host target gene, herein designated VGAM HOST TARGET GENE, is a human gene contained in the human genome.

VGAM31 gene, herein designated VGAM GENE, encodes a VGAM31 precursor RNA, herein designated VGAM PRECURSOR RNA. Similar to other miRNA genes, and unlike most ordinary genes, VGAM31 precursor RNA, herein designated VGAM PRECURSOR RNA, does not encode a protein. A nucleotide sequence identical or highly similar to the nucleotide sequence of VGAM31 precursor RNA is designated SEQ ID:17, and is provided hereinbelow with reference to the sequence listing part. Nucleotide sequence SEQ ID:17 is located at position 188420 relative to the genome of Vaccinia virus.

VGAM31 precursor RNA, herein designated VGAM PRECURSOR RNA, folds onto itself, forming VGAM31 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM31 folded precursor RNA, herein designated VGAM FOLDED PRECURSOR RNA, into VGAM31 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM31 RNA is designated SEQ ID:366, and is provided hereinbelow with reference to the sequence listing part.

VGAM31 host target gene, herein designated VGAM HOST TARGET GENE, encodes a corresponding messenger RNA, VGAM31 host target RNA, herein designated VGAM HOST TARGET RNA. VGAM31 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM31 RNA, herein designated VGAM RNA, binds complementarily to one or more host target binding sites located in untranslated regions of VGAM31 host target RNA, herein designated VGAM HOST TARGET RNA. This complementary binding is due to the fact that the nucleotide sequence of VGAM31 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM31 RNA, herein designated VGAM RNA, may have a different number of host target binding sites in untranslated regions of a VGAM31 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM31 RNA, herein designated VGAM RNA, to host target binding sites on VGAM31 host target RNA, herein designated VGAM HOST TARGET RNA, such as BINDING SITE I, BINDING SITE II and BINDING SITE III, inhibits translation of VGAM31 host target RNA, herein designated VGAM HOST TARGET RNA, into VGAM31 host target protein, herein designated VGAM HOST TARGET PROTEIN. VGAM host target protein is therefore outlined by a broken line.

It is appreciated that VGAM31 host target gene, herein designated VGAM HOST TARGET GENE, in fact represents a plurality of VGAM31 host target genes. The mRNA of each one of this plurality of VGAM31 host target genes comprises one or more host target binding sites, each having a nucleotide sequence which is at least partly complementary to VGAM31 RNA, herein designated VGAM RNA, and which when bound by VGAM31 RNA, herein designated VGAM RNA, causes inhibition of translation of respective one or more VGAM31 host target proteins.

It is further appreciated by one skilled in the art that the mode of translational inhibition illustrated by FIG. 1 with specific reference to translational inhibition exerted by VGAM31 gene, herein designated VGAM GENE, on one or more VGAM31 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM31 is inhibition of expression of host target genes, as part of a novel viral mechanism of attacking a host. Accordingly, utilities of VGAM31 include diagnosis, prevention and treatment of viral infection by Vaccinia virus. Specific functions, and accordingly utilities, of VGAM31 correlate with, and may be deduced from, the identity of the host target genes which VGAM31 binds and inhibits, and the function of these host target genes, as elaborated hereinbelow.

Nucleotide sequences of the VGAM31 precursor RNA, herein designated VGAM PRECURSOR RNA, and of the diced VGAM31 RNA, herein designated VGAM RNA, and a schematic representation of the secondary folding of VGAM31 folded precursor RNA, herein designated VGAM FOLDED PRECURSOR RNA, of VGAM31 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM31 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 32 (VGAM32) viral gene, which modulates expression of respective host target genes thereof, the function and utility of which host target genes is known in the art.

VGAM32 is a novel bioinformatically detected regulatory, non protein coding, viral micro RNA (miRNA) gene. The method by which VGAM32 was detected is described hereinabove with reference to FIGS. 2-8.

VGAM32 gene, herein designated VGAM GENE, is a viral gene contained in the genome of Vaccinia virus. VGAM32 host target gene, herein designated VGAM HOST TARGET GENE, is a human gene contained in the human genome.

VGAM32 gene, herein designated VGAM GENE, encodes a VGAM32 precursor RNA, herein designated VGAM PRECURSOR RNA. Similar to other miRNA genes, and unlike most ordinary genes, VGAM32 precursor RNA, herein designated VGAM PRECURSOR RNA, does not encode a protein. A nucleotide sequence identical or highly similar to the nucleotide sequence of VGAM32 precursor RNA is designated SEQ ID:18, and is provided hereinbelow with reference to the sequence listing part. Nucleotide sequence SEQ ID:18 is located at position 190813 relative to the genome of Vaccinia virus.

VGAM32 precursor RNA, herein designated VGAM PRECURSOR RNA, folds onto itself, forming VGAM32 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM32 folded precursor RNA, herein designated VGAM FOLDED PRECURSOR RNA, into VGAM32 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM32 RNA is designated SEQ ID:367, and is provided hereinbelow with reference to the sequence listing part.

VGAM32 host target gene, herein designated VGAM HOST TARGET GENE, encodes a corresponding messenger RNA, VGAM32 host target RNA, herein designated VGAM HOST TARGET RNA. VGAM32 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM32 RNA, herein designated VGAM RNA, binds complementarily to one or more host target binding sites located in untranslated regions of VGAM32 host target RNA, herein designated VGAM HOST TARGET RNA. This complementary binding is due to the fact that the nucleotide sequence of VGAM32 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM32 RNA, herein designated VGAM RNA, may have a different number of host target binding sites in untranslated regions of a VGAM32 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM32 RNA, herein designated VGAM RNA, to host target binding sites on VGAM32 host target RNA, herein designated VGAM HOST TARGET RNA, such as BINDING SITE I, BINDING SITE II and BINDING SITE III, inhibits translation of VGAM32 host target RNA, herein designated VGAM HOST TARGET RNA, into VGAM32 host target protein, herein designated VGAM HOST TARGET PROTEIN. VGAM host target protein is therefore outlined by a broken line.

It is appreciated that VGAM32 host target gene, herein designated VGAM HOST TARGET GENE, in fact represents a plurality of VGAM32 host target genes. The mRNA of each one of this plurality of VGAM32 host target genes comprises one or more host target binding sites, each having a nucleotide sequence which is at least partly complementary to VGAM32 RNA, herein designated VGAM RNA, and which when bound by VGAM32 RNA, herein designated VGAM RNA, causes inhibition of translation of respective one or more VGAM32 host target proteins.

It is further appreciated by one skilled in the art that the mode of translational inhibition illustrated by FIG. 1 with specific reference to translational inhibition exerted by VGAM32 gene, herein designated VGAM GENE, on one or more VGAM32 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM32 is inhibition of expression of host target genes, as part of a novel viral mechanism of attacking a host. Accordingly, utilities of VGAM32 include diagnosis, prevention and treatment of viral infection by Vaccinia virus. Specific functions, and accordingly utilities, of VGAM32 correlate with, and may be deduced from, the identity of the host target genes which VGAM32 binds and inhibits, and the function of these host target genes, as elaborated hereinbelow.

Nucleotide sequences of the VGAM32 precursor RNA, herein designated VGAM PRECURSOR RNA, and of the diced VGAM32 RNA, herein designated VGAM RNA, and a schematic representation of the secondary folding of VGAM32 folded precursor RNA, herein designated VGAM FOLDED PRECURSOR RNA, of VGAM32 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM32 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 33 (VGAM33) viral gene, which modulates expression of respective host target genes thereof, the function and utility of which host target genes is known in the art.

VGAM33 is a novel bioinformatically detected regulatory, non protein coding, viral micro RNA (miRNA) gene. The method by which VGAM33 was detected is described hereinabove with reference to FIGS. 2-8.

VGAM33 gene, herein designated VGAM GENE, is a viral gene contained in the genome of Vaccinia virus. VGAM33 host target gene, herein designated VGAM HOST TARGET GENE, is a human gene contained in the human genome.

VGAM33 gene, herein designated VGAM GENE, encodes a VGAM33 precursor RNA, herein designated VGAM PRECURSOR RNA. Similar to other miRNA genes, and unlike most ordinary genes, VGAM33 precursor RNA, herein designated VGAM PRECURSOR RNA, does not encode a protein. A nucleotide sequence identical or highly similar to the nucleotide sequence of VGAM33 precursor RNA is designated SEQ ID:19, and is provided hereinbelow with reference to the sequence listing part. Nucleotide sequence SEQ ID:19 is located at position 190813 relative to the genome of Vaccinia virus.

VGAM33 precursor RNA, herein designated VGAM PRECURSOR RNA, folds onto itself, forming VGAM33 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM33 folded precursor RNA, herein designated VGAM FOLDED PRECURSOR RNA, into VGAM33 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM33 RNA is designated SEQ ID:368, and is provided hereinbelow with reference to the sequence listing part.

VGAM33 host target gene, herein designated VGAM HOST TARGET GENE, encodes a corresponding messenger RNA, VGAM33 host target RNA, herein designated VGAM HOST TARGET RNA. VGAM33 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM33 RNA, herein designated VGAM RNA, binds complementarily to one or more host target binding sites located in untranslated regions of VGAM33 host target RNA, herein designated VGAM HOST TARGET RNA. This complementary binding is due to the fact that the nucleotide sequence of VGAM33 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM33 RNA, herein designated VGAM RNA, may have a different number of host target binding sites in untranslated regions of a VGAM33 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM33 RNA, herein designated VGAM RNA, to host target binding sites on VGAM33 host target RNA, herein designated VGAM HOST TARGET RNA, such as BINDING SITE I, BINDING SITE II and BINDING SITE III, inhibits translation of VGAM33 host target RNA, herein designated VGAM HOST TARGET RNA, into VGAM33 host target protein, herein designated VGAM HOST TARGET PROTEIN. VGAM host target protein is therefore outlined by a broken line.

It is appreciated that VGAM33 host target gene, herein designated VGAM HOST TARGET GENE, in fact represents a plurality of VGAM33 host target genes. The mRNA of each one of this plurality of VGAM33 host target genes comprises one or more host target binding sites, each having a nucleotide sequence which is at least partly complementary to VGAM33 RNA, herein designated VGAM RNA, and which when bound by VGAM33 RNA, herein designated VGAM RNA, causes inhibition of translation of respective one or more VGAM33 host target proteins.

It is further appreciated by one skilled in the art that the mode of translational inhibition illustrated by FIG. 1 with specific reference to translational inhibition exerted by VGAM33 gene, herein designated VGAM GENE, on one or more VGAM33 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM33 is inhibition of expression of host target genes, as part of a novel viral mechanism of attacking a host. Accordingly, utilities of VGAM33 include diagnosis, prevention and treatment of viral infection by Vaccinia virus. Specific functions, and accordingly utilities, of VGAM33 correlate with, and may be deduced from, the identity of the host target genes which VGAM33 binds and inhibits, and the function of these host target genes, as elaborated hereinbelow.

Nucleotide sequences of the VGAM33 precursor RNA, herein designated VGAM PRECURSOR RNA, and of the diced VGAM33 RNA, herein designated VGAM RNA, and a schematic representation of the secondary folding of VGAM33 folded precursor RNA, herein designated VGAM FOLDED PRECURSOR RNA, of VGAM33 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM33 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 34 (VGAM34) viral gene, which modulates expression of respective host target genes thereof, the function and utility of which host target genes is known in the art.

VGAM34 is a novel bioinformatically detected regulatory, non protein coding, viral micro RNA (miRNA) gene. The method by which VGAM34 was detected is described hereinabove with reference to FIGS. 2-8.

VGAM34 gene, herein designated VGAM GENE, is a viral gene contained in the genome of Vaccinia virus. VGAM34 host target gene, herein designated VGAM HOST TARGET GENE, is a human gene contained in the human genome.

VGAM34 gene, herein designated VGAM GENE, encodes a VGAM34 precursor RNA, herein designated VGAM PRECURSOR RNA. Similar to other miRNA genes, and unlike most ordinary genes, VGAM34 precursor RNA, herein designated VGAM PRECURSOR RNA, does not encode a protein. A nucleotide sequence identical or highly similar to the nucleotide sequence of VGAM34 precursor RNA is designated SEQ ID:20, and is provided hereinbelow with reference to the sequence listing part. Nucleotide sequence SEQ ID:20 is located at position 188778 relative to the genome of Vaccinia virus.

VGAM34 precursor RNA, herein designated VGAM PRECURSOR RNA, folds onto itself, forming VGAM34 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM34 folded precursor RNA, herein designated VGAM FOLDED PRECURSOR RNA, into VGAM34 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 90%) nucleotide sequence of VGAM34 RNA is designated SEQ ID:369, and is provided hereinbelow with reference to the sequence listing part.

VGAM34 host target gene, herein designated VGAM HOST TARGET GENE, encodes a corresponding messenger RNA, VGAM34 host target RNA, herein designated VGAM HOST TARGET RNA. VGAM34 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM34 RNA, herein designated VGAM RNA, binds complementarily to one or more host target binding sites located in untranslated regions of VGAM34 host target RNA, herein designated VGAM HOST TARGET RNA. This complementary binding is due to the fact that the nucleotide sequence of VGAM34 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM34 RNA, herein designated VGAM RNA, may have a different number of host target binding sites in untranslated regions of a VGAM34 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM34 RNA, herein designated VGAM RNA, to host target binding sites on VGAM34 host target RNA, herein designated VGAM HOST TARGET RNA, such as BINDING SITE I, BINDING SITE II and BINDING SITE III, inhibits translation of VGAM34 host target RNA, herein designated VGAM HOST TARGET RNA, into VGAM34 host target protein, herein designated VGAM HOST TARGET PROTEIN. VGAM host target protein is therefore outlined by a broken line.

It is appreciated that VGAM34 host target gene, herein designated VGAM HOST TARGET GENE, in fact represents a plurality of VGAM34 host target genes. The mRNA of each one of this plurality of VGAM34 host target genes comprises one or more host target binding sites, each having a nucleotide sequence which is at least partly complementary to VGAM34 RNA, herein designated VGAM RNA, and which when bound by VGAM34 RNA, herein designated VGAM RNA, causes inhibition of translation of respective one or more VGAM34 host target proteins.

It is further appreciated by one skilled in the art that the mode of translational inhibition illustrated by FIG. 1 with specific reference to translational inhibition exerted by VGAM34 gene, herein designated VGAM GENE, on one or more VGAM34 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM34 is inhibition of expression of host target genes, as part of a novel viral mechanism of attacking a host. Accordingly, utilities of VGAM34 include diagnosis, prevention and treatment of viral infection by Vaccinia virus. Specific functions, and accordingly utilities, of VGAM34 correlate with, and may be deduced from, the identity of the host target genes which VGAM34 binds and inhibits, and the function of these host target genes, as elaborated hereinbelow.

Nucleotide sequences of the VGAM34 precursor RNA, herein designated VGAM PRECURSOR RNA, and of the diced VGAM34 RNA, herein designated VGAM RNA, and a schematic representation of the secondary folding of VGAM34 folded precursor RNA, herein designated VGAM FOLDED PRECURSOR RNA, of VGAM34 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM34 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 35 (VGAM35) viral gene, which modulates expression of respective host target genes thereof, the function and utility of which host target genes is known in the art.

VGAM35 is a novel bioinformatically detected regulatory, non protein coding, viral micro RNA (miRNA) gene. The method by which VGAM35 was detected is described hereinabove with reference to FIGS. 2-8.

VGAM35 gene, herein designated VGAM GENE, is a viral gene contained in the genome of Vaccinia virus. VGAM35 host target gene, herein designated VGAM HOST TARGET GENE, is a human gene contained in the human genome.

VGAM35 gene, herein designated VGAM GENE, encodes a VGAM35 precursor RNA, herein designated VGAM PRECURSOR RNA. Similar to other miRNA genes, and unlike most ordinary genes, VGAM35 precursor RNA, herein designated VGAM PRECURSOR RNA, does not encode a protein. A nucleotide sequence identical or highly similar to the nucleotide sequence of VGAM35 precursor RNA is designated SEQ ID:21, and is provided hereinbelow with reference to the sequence listing part. Nucleotide sequence SEQ ID:21 is located at position 642 relative to the genome of Vaccinia virus.

VGAM35 precursor RNA, herein designated VGAM PRECURSOR RNA, folds onto itself, forming VGAM35 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM35 folded precursor RNA, herein designated VGAM FOLDED PRECURSOR RNA, into VGAM35 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM35 RNA is designated SEQ ID:370, and is provided hereinbelow with reference to the sequence listing part.

VGAM35 host target gene, herein designated VGAM HOST TARGET GENE, encodes a corresponding messenger RNA, VGAM35 host target RNA, herein designated VGAM HOST TARGET RNA. VGAM35 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM35 RNA, herein designated VGAM RNA, binds complementarily to one or more host target binding sites located in untranslated regions of VGAM35 host target RNA, herein designated VGAM HOST TARGET RNA. This complementary binding is due to the fact that the nucleotide sequence of VGAM35 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM35 RNA, herein designated VGAM RNA, may have a different number of host target binding sites in untranslated regions of a VGAM35 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM35 RNA, herein designated VGAM RNA, to host target binding sites on VGAM35 host target RNA, herein designated VGAM HOST TARGET RNA, such as BINDING SITE I, BINDING SITE II and BINDING SITE III, inhibits translation of VGAM35 host target RNA, herein designated VGAM HOST TARGET RNA, into VGAM35 host target protein, herein designated VGAM HOST TARGET PROTEIN. VGAM host target protein is therefore outlined by a broken line.

It is appreciated that VGAM35 host target gene, herein designated VGAM HOST TARGET GENE, in fact represents a plurality of VGAM35 host target genes. The mRNA of each one of this plurality of VGAM35 host target genes comprises one or more host target binding sites, each having a nucleotide sequence which is at least partly complementary to VGAM35 RNA, herein designated VGAM RNA, and which when bound by VGAM35 RNA, herein designated VGAM RNA, causes inhibition of translation of respective one or more VGAM35 host target proteins.

It is further appreciated by one skilled in the art that the mode of translational inhibition illustrated by FIG. 1 with specific reference to translational inhibition exerted by VGAM35 gene, herein designated VGAM GENE, on one or more VGAM35 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM35 is inhibition of expression of host target genes, as part of a novel viral mechanism of attacking a host. Accordingly, utilities of VGAM35 include diagnosis, prevention and treatment of viral infection by Vaccinia virus. Specific functions, and accordingly utilities, of VGAM35 correlate with, and may be deduced from, the identity of the host target genes which VGAM35 binds and inhibits, and the function of these host target genes, as elaborated hereinbelow.

Nucleotide sequences of the VGAM35 precursor RNA, herein designated VGAM PRECURSOR RNA, and of the diced VGAM35 RNA, herein designated VGAM RNA, and a schematic representation of the secondary folding of VGAM35 folded precursor RNA, herein designated VGAM FOLDED PRECURSOR RNA, of VGAM35 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM35 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 36 (VGAM36) viral gene, which modulates expression of respective host target genes thereof, the function and utility of which host target genes is known in the art.

VGAM36 is a novel bioinformatically detected regulatory, non protein coding, viral micro RNA (miRNA) gene. The method by which VGAM36 was detected is described hereinabove with reference to FIGS. 2-8.

VGAM36 gene, herein designated VGAM GENE, is a viral gene contained in the genome of Vaccinia virus. VGAM36 host target gene, herein designated VGAM HOST TARGET GENE, is a human gene contained in the human genome.

VGAM36 gene, herein designated VGAM GENE, encodes a VGAM36 precursor RNA, herein designated VGAM PRECURSOR RNA. Similar to other miRNA genes, and unlike most ordinary genes, VGAM36 precursor RNA, herein designated VGAM PRECURSOR RNA, does not encode a protein. A nucleotide sequence identical or highly similar to the nucleotide sequence of VGAM36 precursor RNA is designated SEQ ID:22, and is provided hereinbelow with reference to the sequence listing part. Nucleotide sequence SEQ ID:22 is located at position 3549 relative to the genome of Vaccinia virus.

VGAM36 precursor RNA, herein designated VGAM PRECURSOR RNA, folds onto itself, forming VGAM36 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM36 folded precursor RNA, herein designated VGAM FOLDED PRECURSOR RNA, into VGAM36 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 74%) nucleotide sequence of VGAM36 RNA is designated SEQ ID:371, and is provided hereinbelow with reference to the sequence listing part.

VGAM36 host target gene, herein designated VGAM HOST TARGET GENE, encodes a corresponding messenger RNA, VGAM36 host target RNA, herein designated VGAM HOST TARGET RNA. VGAM36 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM36 RNA, herein designated VGAM RNA, binds complementarily to one or more host target binding sites located in untranslated regions of VGAM36 host target RNA, herein designated VGAM HOST TARGET RNA. This complementary binding is due to the fact that the nucleotide sequence of VGAM36 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM36 RNA, herein designated VGAM RNA, may have a different number of host target binding sites in untranslated regions of a VGAM36 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM36 RNA, herein designated VGAM RNA, to host target binding sites on VGAM36 host target RNA, herein designated VGAM HOST TARGET RNA, such as BINDING SITE I, BINDING SITE II and BINDING SITE III, inhibits translation of VGAM36 host target RNA, herein designated VGAM HOST TARGET RNA, into VGAM36 host target protein, herein designated VGAM HOST TARGET PROTEIN. VGAM host target protein is therefore outlined by a broken line.

It is appreciated that VGAM36 host target gene, herein designated VGAM HOST TARGET GENE, in fact represents a plurality of VGAM36 host target genes. The mRNA of each one of this plurality of VGAM36 host target genes comprises one or more host target binding sites, each having a nucleotide sequence which is at least partly complementary to VGAM36 RNA, herein designated VGAM RNA, and which when bound by VGAM36 RNA, herein designated VGAM RNA, causes inhibition of translation of respective one or more VGAM36 host target proteins.

It is further appreciated by one skilled in the art that the mode of translational inhibition illustrated by FIG. 1 with specific reference to translational inhibition exerted by VGAM36 gene, herein designated VGAM GENE, on one or more VGAM36 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM36 is inhibition of expression of host target genes, as part of a novel viral mechanism of attacking a host. Accordingly, utilities of VGAM36 include diagnosis, prevention and treatment of viral infection by Vaccinia virus. Specific functions, and accordingly utilities, of VGAM36 correlate with, and may be deduced from, the identity of the host target genes which VGAM36 binds and inhibits, and the function of these host target genes, as elaborated hereinbelow.

Nucleotide sequences of the VGAM36 precursor RNA, herein designated VGAM PRECURSOR RNA, and of the diced VGAM36 RNA, herein designated VGAM RNA, and a schematic representation of the secondary folding of VGAM36 folded precursor RNA, herein designated VGAM FOLDED PRECURSOR RNA, of VGAM36 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM36 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 37 (VGAM37) viral gene, which modulates expression of respective host target genes thereof, the function and utility of which host target genes is known in the art.

VGAM37 is a novel bioinformatically detected regulatory, non protein coding, viral micro RNA (miRNA) gene. The method by which VGAM37 was detected is described hereinabove with reference to FIGS. 2-8.

VGAM37 gene, herein designated VGAM GENE, is a viral gene contained in the genome of Vaccinia virus. VGAM37 host target gene, herein designated VGAM HOST TARGET GENE, is a human gene contained in the human genome.

VGAM37 gene, herein designated VGAM GENE, encodes a VGAM37 precursor RNA, herein designated VGAM PRECURSOR RNA. Similar to other miRNA genes, and unlike most ordinary genes, VGAM37 precursor RNA, herein designated VGAM PRECURSOR RNA, does not encode a protein. A nucleotide sequence identical or highly similar to the nucleotide sequence of VGAM37 precursor RNA is designated SEQ ID:23, and is provided hereinbelow with reference to the sequence listing part. Nucleotide sequence SEQ ID:23 is located at position 3549 relative to the genome of Vaccinia virus.

VGAM37 precursor RNA, herein designated VGAM PRECURSOR RNA, folds onto itself, forming VGAM37 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM37 folded precursor RNA, herein designated VGAM FOLDED PRECURSOR RNA, into VGAM37 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 74%) nucleotide sequence of VGAM37 RNA is designated SEQ ID:372, and is provided hereinbelow with reference to the sequence listing part.

VGAM37 host target gene, herein designated VGAM HOST TARGET GENE, encodes a corresponding messenger RNA, VGAM37 host target RNA, herein designated VGAM HOST TARGET RNA. VGAM37 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM37 RNA, herein designated VGAM RNA, binds complementarily to one or more host target binding sites located in untranslated regions of VGAM37 host target RNA, herein designated VGAM HOST TARGET RNA. This complementary binding is due to the fact that the nucleotide sequence of VGAM37 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM37 RNA, herein designated VGAM RNA, may have a different number of host target binding sites in untranslated regions of a VGAM37 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM37 RNA, herein designated VGAM RNA, to host target binding sites on VGAM37 host target RNA, herein designated VGAM HOST TARGET RNA, such as BINDING SITE I, BINDING SITE II and BINDING SITE III, inhibits translation of VGAM37 host target RNA, herein designated VGAM HOST TARGET RNA, into VGAM37 host target protein, herein designated VGAM HOST TARGET PROTEIN. VGAM host target protein is therefore outlined by a broken line.

It is appreciated that VGAM37 host target gene, herein designated VGAM HOST TARGET GENE, in fact represents a plurality of VGAM37 host target genes. The mRNA of each one of this plurality of VGAM37 host target genes comprises one or more host target binding sites, each having a nucleotide sequence which is at least partly complementary to VGAM37 RNA, herein designated VGAM RNA, and which when bound by VGAM37 RNA, herein designated VGAM RNA, causes inhibition of translation of respective one or more VGAM37 host target proteins.

It is further appreciated by one skilled in the art that the mode of translational inhibition illustrated by FIG. 1 with specific reference to translational inhibition exerted by VGAM37 gene, herein designated VGAM GENE, on one or more VGAM37 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM37 is inhibition of expression of host target genes, as part of a novel viral mechanism of attacking a host. Accordingly, utilities of VGAM37 include diagnosis, prevention and treatment of viral infection by Vaccinia virus. Specific functions, and accordingly utilities, of VGAM37 correlate with, and may be deduced from, the identity of the host target genes which VGAM37 binds and inhibits, and the function of these host target genes, as elaborated hereinbelow.

Nucleotide sequences of the VGAM37 precursor RNA, herein designated VGAM PRECURSOR RNA, and of the diced VGAM37 RNA, herein designated VGAM RNA, and a schematic representation of the secondary folding of VGAM37 folded precursor RNA, herein designated VGAM FOLDED PRECURSOR RNA, of VGAM37 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM37 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 38 (VGAM38) viral gene, which modulates expression of respective host target genes thereof, the function and utility of which host target genes is known in the art.

VGAM38 is a novel bioinformatically detected regulatory, non protein coding, viral micro RNA (miRNA) gene. The method by which VGAM38 was detected is described hereinabove with reference to FIGS. 2-8.

VGAM38 gene, herein designated VGAM GENE, is a viral gene contained in the genome of Vaccinia virus. VGAM38 host target gene, herein designated VGAM HOST TARGET GENE, is a human gene contained in the human genome.

VGAM38 gene, herein designated VGAM GENE, encodes a VGAM38 precursor RNA, herein designated VGAM PRECURSOR RNA. Similar to other miRNA genes, and unlike most ordinary genes, VGAM38 precursor RNA, herein designated VGAM PRECURSOR RNA, does not encode a protein. A nucleotide sequence identical or highly similar to the nucleotide sequence of VGAM38 precursor RNA is designated SEQ ID:24, and is provided hereinbelow with reference to the sequence listing part. Nucleotide sequence SEQ ID:24 is located at position 2981 relative to the genome of Vaccinia virus.

VGAM38 precursor RNA, herein designated VGAM PRECURSOR RNA, folds onto itself, forming VGAM38 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM38 folded precursor RNA, herein designated VGAM FOLDED PRECURSOR RNA, into VGAM38 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 79%) nucleotide sequence of VGAM38 RNA is designated SEQ ID:373, and is provided hereinbelow with reference to the sequence listing part.

VGAM38 host target gene, herein designated VGAM HOST TARGET GENE, encodes a corresponding messenger RNA, VGAM38 host target RNA, herein designated VGAM HOST TARGET RNA. VGAM38 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM38 RNA, herein designated VGAM RNA, binds complementarily to one or more host target binding sites located in untranslated regions of VGAM38 host target RNA, herein designated VGAM HOST TARGET RNA. This complementary binding is due to the fact that the nucleotide sequence of VGAM38 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM38 RNA, herein designated VGAM RNA, may have a different number of host target binding sites in untranslated regions of a VGAM38 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM38 RNA, herein designated VGAM RNA, to host target binding sites on VGAM38 host target RNA, herein designated VGAM HOST TARGET RNA, such as BINDING SITE I, BINDING SITE II and BINDING SITE III, inhibits translation of VGAM38 host target RNA, herein designated VGAM HOST TARGET RNA, into VGAM38 host target protein, herein designated VGAM HOST TARGET PROTEIN. VGAM host target protein is therefore outlined by a broken line.

It is appreciated that VGAM38 host target gene, herein designated VGAM HOST TARGET GENE, in fact represents a plurality of VGAM38 host target genes. The mRNA of each one of this plurality of VGAM38 host target genes comprises one or more host target binding sites, each having a nucleotide sequence which is at least partly complementary to VGAM38 RNA, herein designated VGAM RNA, and which when bound by VGAM38 RNA, herein designated VGAM RNA, causes inhibition of translation of respective one or more VGAM38 host target proteins.

It is further appreciated by one skilled in the art that the mode of translational inhibition illustrated by FIG. 1 with specific reference to translational inhibition exerted by VGAM38 gene, herein designated VGAM GENE, on one or more VGAM38 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM38 is inhibition of expression of host target genes, as part of a novel viral mechanism of attacking a host. Accordingly, utilities of VGAM38 include diagnosis, prevention and treatment of viral infection by Vaccinia virus. Specific functions, and accordingly utilities, of VGAM38 correlate with, and may be deduced from, the identity of the host target genes which VGAM38 binds and inhibits, and the function of these host target genes, as elaborated hereinbelow.

Nucleotide sequences of the VGAM38 precursor RNA, herein designated VGAM PRECURSOR RNA, and of the diced VGAM38 RNA, herein designated VGAM RNA, and a schematic representation of the secondary folding of VGAM38 folded precursor RNA, herein designated VGAM FOLDED PRECURSOR RNA, of VGAM38 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM38 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 39 (VGAM39) viral gene, which modulates expression of respective host target genes thereof, the function and utility of which host target genes is known in the art.

VGAM39 is a novel bioinformatically detected regulatory, non protein coding, viral micro RNA (miRNA) gene. The method by which VGAM39 was detected is described hereinabove with reference to FIGS. 2-8.

VGAM39 gene, herein designated VGAM GENE, is a viral gene contained in the genome of Vaccinia virus. VGAM39 host target gene, herein designated VGAM HOST TARGET GENE, is a human gene contained in the human genome.

VGAM39 gene, herein designated VGAM GENE, encodes a VGAM39 precursor RNA, herein designated VGAM PRECURSOR RNA. Similar to other miRNA genes, and unlike most ordinary genes, VGAM39 precursor RNA, herein designated VGAM PRECURSOR RNA, does not encode a protein. A nucleotide sequence identical or highly similar to the nucleotide sequence of VGAM39 precursor RNA is designated SEQ ID:25, and is provided hereinbelow with reference to the sequence listing part. Nucleotide sequence SEQ ID:25 is located at position 963 relative to the genome of Vaccinia virus.

VGAM39 precursor RNA, herein designated VGAM PRECURSOR RNA, folds onto itself, forming VGAM39 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM39 folded precursor RNA, herein designated VGAM FOLDED PRECURSOR RNA, into VGAM39 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM39 RNA is designated SEQ ID:374, and is provided hereinbelow with reference to the sequence listing part.

VGAM39 host target gene, herein designated VGAM HOST TARGET GENE, encodes a corresponding messenger RNA, VGAM39 host target RNA, herein designated VGAM HOST TARGET RNA. VGAM39 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM39 RNA, herein designated VGAM RNA, binds complementarily to one or more host target binding sites located in untranslated regions of VGAM39 host target RNA, herein designated VGAM HOST TARGET RNA. This complementary binding is due to the fact that the nucleotide sequence of VGAM39 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM39 RNA, herein designated VGAM RNA, may have a different number of host target binding sites in untranslated regions of a VGAM39 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM39 RNA, herein designated VGAM RNA, to host target binding sites on VGAM39 host target RNA, herein designated VGAM HOST TARGET RNA, such as BINDING SITE I, BINDING SITE II and BINDING SITE III, inhibits translation of VGAM39 host target RNA, herein designated VGAM HOST TARGET RNA, into VGAM39 host target protein, herein designated VGAM HOST TARGET PROTEIN. VGAM host target protein is therefore outlined by a broken line.

It is appreciated that VGAM39 host target gene, herein designated VGAM HOST TARGET GENE, in fact represents a plurality of VGAM39 host target genes. The mRNA of each one of this plurality of VGAM39 host target genes comprises one or more host target binding sites, each having a nucleotide sequence which is at least partly complementary to VGAM39 RNA, herein designated VGAM RNA, and which when bound by VGAM39 RNA, herein designated VGAM RNA, causes inhibition of translation of respective one or more VGAM39 host target proteins.

It is further appreciated by one skilled in the art that the mode of translational inhibition illustrated by FIG. 1 with specific reference to translational inhibition exerted by VGAM39 gene, herein designated VGAM GENE, on one or more VGAM39 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM39 is inhibition of expression of host target genes, as part of a novel viral mechanism of attacking a host. Accordingly, utilities of VGAM39 include diagnosis, prevention and treatment of viral infection by Vaccinia virus. Specific functions, and accordingly utilities, of VGAM39 correlate with, and may be deduced from, the identity of the host target genes which VGAM39 binds and inhibits, and the function of these host target genes, as elaborated hereinbelow.

Nucleotide sequences of the VGAM39 precursor RNA, herein designated VGAM PRECURSOR RNA, and of the diced VGAM39 RNA, herein designated VGAM RNA, and a schematic representation of the secondary folding of VGAM39 folded precursor RNA, herein designated VGAM FOLDED PRECURSOR RNA, of VGAM39 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM39 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 40 (VGAM40) viral gene, which modulates expression of respective host target genes thereof, the function and utility of which host target genes is known in the art.

VGAM40 is a novel bioinformatically detected regulatory, non protein coding, viral micro RNA (miRNA) gene. The method by which VGAM40 was detected is described hereinabove with reference to FIGS. 2-8.

VGAM40 gene, herein designated VGAM GENE, is a viral gene contained in the genome of Vaccinia virus. VGAM40 host target gene, herein designated VGAM HOST TARGET GENE, is a human gene contained in the human genome.

VGAM40 gene, herein designated VGAM GENE, encodes a VGAM40 precursor RNA, herein designated VGAM PRECURSOR RNA. Similar to other miRNA genes, and unlike most ordinary genes, VGAM40 precursor RNA, herein designated VGAM PRECURSOR RNA, does not encode a protein. A nucleotide sequence identical or highly similar to the nucleotide sequence of VGAM40 precursor RNA is designated SEQ ID:26, and is provided hereinbelow with reference to the sequence listing part. Nucleotide sequence SEQ ID:26 is located at position 963 relative to the genome of Vaccinia virus.

VGAM40 precursor RNA, herein designated VGAM PRECURSOR RNA, folds onto itself, forming VGAM40 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM40 folded precursor RNA, herein designated VGAM FOLDED PRECURSOR RNA, into VGAM40 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM40 RNA is designated SEQ ID:375, and is provided hereinbelow with reference to the sequence listing part.

VGAM40 host target gene, herein designated VGAM HOST TARGET GENE, encodes a corresponding messenger RNA, VGAM40 host target RNA, herein designated VGAM HOST TARGET RNA. VGAM40 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM40 RNA, herein designated VGAM RNA, binds complementarily to one or more host target binding sites located in untranslated regions of VGAM40 host target RNA, herein designated VGAM HOST TARGET RNA. This complementary binding is due to the fact that the nucleotide sequence of VGAM40 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM40 RNA, herein designated VGAM RNA, may have a different number of host target binding sites in untranslated regions of a VGAM40 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM40 RNA, herein designated VGAM RNA, to host target binding sites on VGAM40 host target RNA, herein designated VGAM HOST TARGET RNA, such as BINDING SITE I, BINDING SITE II and BINDING SITE III, inhibits translation of VGAM40 host target RNA, herein designated VGAM HOST TARGET RNA, into VGAM40 host target protein, herein designated VGAM HOST TARGET PROTEIN. VGAM host target protein is therefore outlined by a broken line.

It is appreciated that VGAM40 host target gene, herein designated VGAM HOST TARGET GENE, in fact represents a plurality of VGAM40 host target genes. The mRNA of each one of this plurality of VGAM40 host target genes comprises one or more host target binding sites, each having a nucleotide sequence which is at least partly complementary to VGAM40 RNA, herein designated VGAM RNA, and which when bound by VGAM40 RNA, herein designated VGAM RNA, causes inhibition of translation of respective one or more VGAM40 host target proteins.

It is further appreciated by one skilled in the art that the mode of translational inhibition illustrated by FIG. 1 with specific reference to translational inhibition exerted by VGAM40 gene, herein designated VGAM GENE, on one or more VGAM40 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM40 is inhibition of expression of host target genes, as part of a novel viral mechanism of attacking a host. Accordingly, utilities of VGAM40 include diagnosis, prevention and treatment of viral infection by Vaccinia virus. Specific functions, and accordingly utilities, of VGAM40 correlate with, and may be deduced from, the identity of the host target genes which VGAM40 binds and inhibits, and the function of these host target genes, as elaborated hereinbelow.

Nucleotide sequences of the VGAM40 precursor RNA, herein designated VGAM PRECURSOR RNA, and of the diced VGAM40 RNA, herein designated VGAM RNA, and a schematic representation of the secondary folding of VGAM40 folded precursor RNA, herein designated VGAM FOLDED PRECURSOR RNA, of VGAM40 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM40 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 41 (VGAM41) viral gene, which modulates expression of respective host target genes thereof, the function and utility of which host target genes is known in the art.

VGAM41 is a novel bioinformatically detected regulatory, non protein coding, viral micro RNA (miRNA) gene. The method by which VGAM41 was detected is described hereinabove with reference to FIGS. 2-8.

VGAM41 gene, herein designated VGAM GENE, is a viral gene contained in the genome of Vaccinia virus. VGAM41 host target gene, herein designated VGAM HOST TARGET GENE, is a human gene contained in the human genome.

VGAM41 gene, herein designated VGAM GENE, encodes a VGAM41 precursor RNA, herein designated VGAM PRECURSOR RNA. Similar to other miRNA genes, and unlike most ordinary genes, VGAM41 precursor RNA, herein designated VGAM PRECURSOR RNA, does not encode a protein. A nucleotide sequence identical or highly similar to the nucleotide sequence of VGAM41 precursor RNA is designated SEQ ID:27, and is provided hereinbelow with reference to the sequence listing part. Nucleotide sequence SEQ ID:27 is located at position 963 relative to the genome of Vaccinia virus.

VGAM41 precursor RNA, herein designated VGAM PRECURSOR RNA, folds onto itself, forming VGAM41 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM41 folded precursor RNA, herein designated VGAM FOLDED PRECURSOR RNA, into VGAM41 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM41 RNA is designated SEQ ID:376, and is provided hereinbelow with reference to the sequence listing part.

VGAM41 host target gene, herein designated VGAM HOST TARGET GENE, encodes a corresponding messenger RNA, VGAM41 host target RNA, herein designated VGAM HOST TARGET RNA. VGAM41 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM41 RNA, herein designated VGAM RNA, binds complementarily to one or more host target binding sites located in untranslated regions of VGAM41 host target RNA, herein designated VGAM HOST TARGET RNA. This complementary binding is due to the fact that the nucleotide sequence of VGAM41 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM41 RNA, herein designated VGAM RNA, may have a different number of host target binding sites in untranslated regions of a VGAM41 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM41 RNA, herein designated VGAM RNA, to host target binding sites on VGAM41 host target RNA, herein designated VGAM HOST TARGET RNA, such as BINDING SITE I, BINDING SITE II and BINDING SITE III, inhibits translation of VGAM41 host target RNA, herein designated VGAM HOST TARGET RNA, into VGAM41 host target protein, herein designated VGAM HOST TARGET PROTEIN. VGAM host target protein is therefore outlined by a broken line.

It is appreciated that VGAM41 host target gene, herein designated VGAM HOST TARGET GENE, in fact represents a plurality of VGAM41 host target genes. The mRNA of each one of this plurality of VGAM41 host target genes comprises one or more host target binding sites, each having a nucleotide sequence which is at least partly complementary to VGAM41 RNA, herein designated VGAM RNA, and which when bound by VGAM41 RNA, herein designated VGAM RNA, causes inhibition of translation of respective one or more VGAM41 host target proteins.

It is further appreciated by one skilled in the art that the mode of translational inhibition illustrated by FIG. 1 with specific reference to translational inhibition exerted by VGAM41 gene, herein designated VGAM GENE, on one or more VGAM41 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM41 is inhibition of expression of host target genes, as part of a novel viral mechanism of attacking a host. Accordingly, utilities of VGAM41 include diagnosis, prevention and treatment of viral infection by Vaccinia virus. Specific functions, and accordingly utilities, of VGAM41 correlate with, and may be deduced from, the identity of the host target genes which VGAM41 binds and inhibits, and the function of these host target genes, as elaborated hereinbelow.

Nucleotide sequences of the VGAM41 precursor RNA, herein designated VGAM PRECURSOR RNA, and of the diced VGAM41 RNA, herein designated VGAM RNA, and a schematic representation of the secondary folding of VGAM41 folded precursor RNA, herein designated VGAM FOLDED PRECURSOR RNA, of VGAM41 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM41 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 42 (VGAM42) viral gene, which modulates expression of respective host target genes thereof, the function and utility of which host target genes is known in the art.

VGAM42 is a novel bioinformatically detected regulatory, non protein coding, viral micro RNA (miRNA) gene. The method by which VGAM42 was detected is described hereinabove with reference to FIGS. 2-8.

VGAM42 gene, herein designated VGAM GENE, is a viral gene contained in the genome of Vaccinia virus. VGAM42 host target gene, herein designated VGAM HOST TARGET GENE, is a human gene contained in the human genome.

VGAM42 gene, herein designated VGAM GENE, encodes a VGAM42 precursor RNA, herein designated VGAM PRECURSOR RNA. Similar to other miRNA genes, and unlike most ordinary genes, VGAM42 precursor RNA, herein designated VGAM PRECURSOR RNA, does not encode a protein. A nucleotide sequence identical or highly similar to the nucleotide sequence of VGAM42 precursor RNA is designated SEQ ID:28, and is provided hereinbelow with reference to the sequence listing part. Nucleotide sequence SEQ ID:28 is located at position 963 relative to the genome of Vaccinia virus.

VGAM42 precursor RNA, herein designated VGAM PRECURSOR RNA, folds onto itself, forming VGAM42 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM42 folded precursor RNA, herein designated VGAM FOLDED PRECURSOR RNA, into VGAM42 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM42 RNA is designated SEQ ID:377, and is provided hereinbelow with reference to the sequence listing part.

VGAM42 host target gene, herein designated VGAM HOST TARGET GENE, encodes a corresponding messenger RNA, VGAM42 host target RNA, herein designated VGAM HOST TARGET RNA. VGAM42 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM42 RNA, herein designated VGAM RNA, binds complementarily to one or more host target binding sites located in untranslated regions of VGAM42 host target RNA, herein designated VGAM HOST TARGET RNA. This complementary binding is due to the fact that the nucleotide sequence of VGAM42 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM42 RNA, herein designated VGAM RNA, may have a different number of host target binding sites in untranslated regions of a VGAM42 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM42 RNA, herein designated VGAM RNA, to host target binding sites on VGAM42 host target RNA, herein designated VGAM HOST TARGET RNA, such as BINDING SITE I, BINDING SITE II and BINDING SITE III, inhibits translation of VGAM42 host target RNA, herein designated VGAM HOST TARGET RNA, into VGAM42 host target protein, herein designated VGAM HOST TARGET PROTEIN. VGAM host target protein is therefore outlined by a broken line.

It is appreciated that VGAM42 host target gene, herein designated VGAM HOST TARGET GENE, in fact represents a plurality of VGAM42 host target genes. The mRNA of each one of this plurality of VGAM42 host target genes comprises one or more host target binding sites, each having a nucleotide sequence which is at least partly complementary to VGAM42 RNA, herein designated VGAM RNA, and which when bound by VGAM42 RNA, herein designated VGAM RNA, causes inhibition of translation of respective one or more VGAM42 host target proteins.

It is further appreciated by one skilled in the art that the mode of translational inhibition illustrated by FIG. 1 with specific reference to translational inhibition exerted by VGAM42 gene, herein designated VGAM GENE, on one or more VGAM42 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM42 is inhibition of expression of host target genes, as part of a novel viral mechanism of attacking a host. Accordingly, utilities of VGAM42 include diagnosis, prevention and treatment of viral infection by Vaccinia virus. Specific functions, and accordingly utilities, of VGAM42 correlate with, and may be deduced from, the identity of the host target genes which VGAM42 binds and inhibits, and the function of these host target genes, as elaborated hereinbelow.

Nucleotide sequences of the VGAM42 precursor RNA, herein designated VGAM PRECURSOR RNA, and of the diced VGAM42 RNA, herein designated VGAM RNA, and a schematic representation of the secondary folding of VGAM42 folded precursor RNA, herein designated VGAM FOLDED PRECURSOR RNA, of VGAM42 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM42 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 43 (VGAM43) viral gene, which modulates expression of respective host target genes thereof, the function and utility of which host target genes is known in the art.

VGAM43 is a novel bioinformatically detected regulatory, non protein coding, viral micro RNA (miRNA) gene. The method by which VGAM43 was detected is described hereinabove with reference to FIGS. 2-8.

VGAM43 gene, herein designated VGAM GENE, is a viral gene contained in the genome of Vaccinia virus. VGAM43 host target gene, herein designated VGAM HOST TARGET GENE, is a human gene contained in the human genome.

VGAM43 gene, herein designated VGAM GENE, encodes a VGAM43 precursor RNA, herein designated VGAM PRECURSOR RNA. Similar to other miRNA genes, and unlike most ordinary genes, VGAM43 precursor RNA, herein designated VGAM PRECURSOR RNA, does not encode a protein. A nucleotide sequence identical or highly similar to the nucleotide sequence of VGAM43 precursor RNA is designated SEQ ID:29, and is provided hereinbelow with reference to the sequence listing part. Nucleotide sequence SEQ ID:29 is located at position 963 relative to the genome of Vaccinia virus.

VGAM43 precursor RNA, herein designated VGAM PRECURSOR RNA, folds onto itself, forming VGAM43 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM43 folded precursor RNA, herein designated VGAM FOLDED PRECURSOR RNA, into VGAM43 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM43 RNA is designated SEQ ID:378, and is provided hereinbelow with reference to the sequence listing part.

VGAM43 host target gene, herein designated VGAM HOST TARGET GENE, encodes a corresponding messenger RNA, VGAM43 host target RNA, herein designated VGAM HOST TARGET RNA. VGAM43 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM43 RNA, herein designated VGAM RNA, binds complementarily to one or more host target binding sites located in untranslated regions of VGAM43 host target RNA, herein designated VGAM HOST TARGET RNA. This complementary binding is due to the fact that the nucleotide sequence of VGAM43 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM43 RNA, herein designated VGAM RNA, may have a different number of host target binding sites in untranslated regions of a VGAM43 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM43 RNA, herein designated VGAM RNA, to host target binding sites on VGAM43 host target RNA, herein designated VGAM HOST TARGET RNA, such as BINDING SITE I, BINDING SITE II and BINDING SITE III, inhibits translation of VGAM43 host target RNA, herein designated VGAM HOST TARGET RNA, into VGAM43 host target protein, herein designated VGAM HOST TARGET PROTEIN. VGAM host target protein is therefore outlined by a broken line.

It is appreciated that VGAM43 host target gene, herein designated VGAM HOST TARGET GENE, in fact represents a plurality of VGAM43 host target genes. The mRNA of each one of this plurality of VGAM43 host target genes comprises one or more host target binding sites, each having a nucleotide sequence which is at least partly complementary to VGAM43 RNA, herein designated VGAM RNA, and which when bound by VGAM43 RNA, herein designated VGAM RNA, causes inhibition of translation of respective one or more VGAM43 host target proteins.

It is further appreciated by one skilled in the art that the mode of translational inhibition illustrated by FIG. 1 with specific reference to translational inhibition exerted by VGAM43 gene, herein designated VGAM GENE, on one or more VGAM43 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM43 is inhibition of expression of host target genes, as part of a novel viral mechanism of attacking a host. Accordingly, utilities of VGAM43 include diagnosis, prevention and treatment of viral infection by Vaccinia virus. Specific functions, and accordingly utilities, of VGAM43 correlate with, and may be deduced from, the identity of the host target genes which VGAM43 binds and inhibits, and the function of these host target genes, as elaborated hereinbelow.

Nucleotide sequences of the VGAM43 precursor RNA, herein designated VGAM PRECURSOR RNA, and of the diced VGAM43 RNA, herein designated VGAM RNA, and a schematic representation of the secondary folding of VGAM43 folded precursor RNA, herein designated VGAM FOLDED PRECURSOR RNA, of VGAM43 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM43 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 44 (VGAM44) viral gene, which modulates expression of respective host target genes thereof, the function and utility of which host target genes is known in the art.

VGAM44 is a novel bioinformatically detected regulatory, non protein coding, viral micro RNA (miRNA) gene. The method by which VGAM44 was detected is described hereinabove with reference to FIGS. 2-8.

VGAM44 gene, herein designated VGAM GENE, is a viral gene contained in the genome of Vaccinia virus. VGAM44 host target gene, herein designated VGAM HOST TARGET GENE, is a human gene contained in the human genome.

VGAM44 gene, herein designated VGAM GENE, encodes a VGAM44 precursor RNA, herein designated VGAM PRECURSOR RNA. Similar to other miRNA genes, and unlike most ordinary genes, VGAM44 precursor RNA, herein designated VGAM PRECURSOR RNA, does not encode a protein. A nucleotide sequence identical or highly similar to the nucleotide sequence of VGAM44 precursor RNA is designated SEQ ID:30, and is provided hereinbelow with reference to the sequence listing part. Nucleotide sequence SEQ ID:30 is located at position 963 relative to the genome of Vaccinia virus.

VGAM44 precursor RNA, herein designated VGAM PRECURSOR RNA, folds onto itself, forming VGAM44 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM44 folded precursor RNA, herein designated VGAM FOLDED PRECURSOR RNA, into VGAM44 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM44 RNA is designated SEQ ID:379, and is provided hereinbelow with reference to the sequence listing part.

VGAM44 host target gene, herein designated VGAM HOST TARGET GENE, encodes a corresponding messenger RNA, VGAM44 host target RNA, herein designated VGAM HOST TARGET RNA. VGAM44 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM44 RNA, herein designated VGAM RNA, binds complementarily to one or more host target binding sites located in untranslated regions of VGAM44 host target RNA, herein designated VGAM HOST TARGET RNA. This complementary binding is due to the fact that the nucleotide sequence of VGAM44 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM44 RNA, herein designated VGAM RNA, may have a different number of host target binding sites in untranslated regions of a VGAM44 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM44 RNA, herein designated VGAM RNA, to host target binding sites on VGAM44 host target RNA, herein designated VGAM HOST TARGET RNA, such as BINDING SITE I, BINDING SITE II and BINDING SITE III, inhibits translation of VGAM44 host target RNA, herein designated VGAM HOST TARGET RNA, into VGAM44 host target protein, herein designated VGAM HOST TARGET PROTEIN. VGAM host target protein is therefore outlined by a broken line.

It is appreciated that VGAM44 host target gene, herein designated VGAM HOST TARGET GENE, in fact represents a plurality of VGAM44 host target genes. The mRNA of each one of this plurality of VGAM44 host target genes comprises one or more host target binding sites, each having a nucleotide sequence which is at least partly complementary to VGAM44 RNA, herein designated VGAM RNA, and which when bound by VGAM44 RNA, herein designated VGAM RNA, causes inhibition of translation of respective one or more VGAM44 host target proteins.

It is further appreciated by one skilled in the art that the mode of translational inhibition illustrated by FIG. 1 with specific reference to translational inhibition exerted by VGAM44 gene, herein designated VGAM GENE, on one or more VGAM44 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM44 is inhibition of expression of host target genes, as part of a novel viral mechanism of attacking a host. Accordingly, utilities of VGAM44 include diagnosis, prevention and treatment of viral infection by Vaccinia virus. Specific functions, and accordingly utilities, of VGAM44 correlate with, and may be deduced from, the identity of the host target genes which VGAM44 binds and inhibits, and the function of these host target genes, as elaborated hereinbelow.

Nucleotide sequences of the VGAM44 precursor RNA, herein designated VGAM PRECURSOR RNA, and of the diced VGAM44 RNA, herein designated VGAM RNA, and a schematic representation of the secondary folding of VGAM44 folded precursor RNA, herein designated VGAM FOLDED PRECURSOR RNA, of VGAM44 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM44 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 45 (VGAM45) viral gene, which modulates expression of respective host target genes thereof, the function and utility of which host target genes is known in the art.

VGAM45 is a novel bioinformatically detected regulatory, non protein coding, viral micro RNA (miRNA) gene. The method by which VGAM45 was detected is described hereinabove with reference to FIGS. 2-8.

VGAM45 gene, herein designated VGAM GENE, is a viral gene contained in the genome of Vaccinia virus. VGAM45 host target gene, herein designated VGAM HOST TARGET GENE, is a human gene contained in the human genome.

VGAM45 gene, herein designated VGAM GENE, encodes a VGAM45 precursor RNA, herein designated VGAM PRECURSOR RNA. Similar to other miRNA genes, and unlike most ordinary genes, VGAM45 precursor RNA, herein designated VGAM PRECURSOR RNA, does not encode a protein. A nucleotide sequence identical or highly similar to the nucleotide sequence of VGAM45 precursor RNA is designated SEQ ID:31, and is provided hereinbelow with reference to the sequence listing part. Nucleotide sequence SEQ ID:31 is located at position 2576 relative to the genome of Vaccinia virus.

VGAM45 precursor RNA, herein designated VGAM PRECURSOR RNA, folds onto itself, forming VGAM45 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM45 folded precursor RNA, herein designated VGAM FOLDED PRECURSOR RNA, into VGAM45 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM45 RNA is designated SEQ ID:380, and is provided hereinbelow with reference to the sequence listing part.

VGAM45 host target gene, herein designated VGAM HOST TARGET GENE, encodes a corresponding messenger RNA, VGAM45 host target RNA, herein designated VGAM HOST TARGET RNA. VGAM45 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM45 RNA, herein designated VGAM RNA, binds complementarily to one or more host target binding sites located in untranslated regions of VGAM45 host target RNA, herein designated VGAM HOST TARGET RNA. This complementary binding is due to the fact that the nucleotide sequence of VGAM45 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM45 RNA, herein designated VGAM RNA, may have a different number of host target binding sites in untranslated regions of a VGAM45 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM45 RNA, herein designated VGAM RNA, to host target binding sites on VGAM45 host target RNA, herein designated VGAM HOST TARGET RNA, such as BINDING SITE I, BINDING SITE II and BINDING SITE III, inhibits translation of VGAM45 host target RNA, herein designated VGAM HOST TARGET RNA, into VGAM45 host target protein, herein designated VGAM HOST TARGET PROTEIN. VGAM host target protein is therefore outlined by a broken line.

It is appreciated that VGAM45 host target gene, herein designated VGAM HOST TARGET GENE, in fact represents a plurality of VGAM45 host target genes. The mRNA of each one of this plurality of VGAM45 host target genes comprises one or more host target binding sites, each having a nucleotide sequence which is at least partly complementary to VGAM45 RNA, herein designated VGAM RNA, and which when bound by VGAM45 RNA, herein designated VGAM RNA, causes inhibition of translation of respective one or more VGAM45 host target proteins.

It is further appreciated by one skilled in the art that the mode of translational inhibition illustrated by FIG. 1 with specific reference to translational inhibition exerted by VGAM45 gene, herein designated VGAM GENE, on one or more VGAM45 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM45 is inhibition of expression of host target genes, as part of a novel viral mechanism of attacking a host. Accordingly, utilities of VGAM45 include diagnosis, prevention and treatment of viral infection by Vaccinia virus. Specific functions, and accordingly utilities, of VGAM45 correlate with, and may be deduced from, the identity of the host target genes which VGAM45 binds and inhibits, and the function of these host target genes, as elaborated hereinbelow.

Nucleotide sequences of the VGAM45 precursor RNA, herein designated VGAM PRECURSOR RNA, and of the diced VGAM45 RNA, herein designated VGAM RNA, and a schematic representation of the secondary folding of VGAM45 folded precursor RNA, herein designated VGAM FOLDED PRECURSOR RNA, of VGAM45 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM45 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 46 (VGAM46) viral gene, which modulates expression of respective host target genes thereof, the function and utility of which host target genes is known in the art.

VGAM46 is a novel bioinformatically detected regulatory, non protein coding, viral micro RNA (miRNA) gene. The method by which VGAM46 was detected is described hereinabove with reference to FIGS. 2-8.

VGAM46 gene, herein designated VGAM GENE, is a viral gene contained in the genome of Vaccinia virus. VGAM46 host target gene, herein designated VGAM HOST TARGET GENE, is a human gene contained in the human genome.

VGAM46 gene, herein designated VGAM GENE, encodes a VGAM46 precursor RNA, herein designated VGAM PRECURSOR RNA. Similar to other miRNA genes, and unlike most ordinary genes, VGAM46 precursor RNA, herein designated VGAM PRECURSOR RNA, does not encode a protein. A nucleotide sequence identical or highly similar to the nucleotide sequence of VGAM46 precursor RNA is designated SEQ ID:32, and is provided hereinbelow with reference to the sequence listing part. Nucleotide sequence SEQ ID:32 is located at position 4213 relative to the genome of Vaccinia virus.

VGAM46 precursor RNA, herein designated VGAM PRECURSOR RNA, folds onto itself, forming VGAM46 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM46 folded precursor RNA, herein designated VGAM FOLDED PRECURSOR RNA, into VGAM46 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM46 RNA is designated SEQ ID:381, and is provided hereinbelow with reference to the sequence listing part.

VGAM46 host target gene, herein designated VGAM HOST TARGET GENE, encodes a corresponding messenger RNA, VGAM46 host target RNA, herein designated VGAM HOST TARGET RNA. VGAM46 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM46 RNA, herein designated VGAM RNA, binds complementarily to one or more host target binding sites located in untranslated regions of VGAM46 host target RNA, herein designated VGAM HOST TARGET RNA. This complementary binding is due to the fact that the nucleotide sequence of VGAM46 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM46 RNA, herein designated VGAM RNA, may have a different number of host target binding sites in untranslated regions of a VGAM46 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM46 RNA, herein designated VGAM RNA, to host target binding sites on VGAM46 host target RNA, herein designated VGAM HOST TARGET RNA, such as BINDING SITE I, BINDING SITE II and BINDING SITE III, inhibits translation of VGAM46 host target RNA, herein designated VGAM HOST TARGET RNA, into VGAM46 host target protein, herein designated VGAM HOST TARGET PROTEIN. VGAM host target protein is therefore outlined by a broken line.

It is appreciated that VGAM46 host target gene, herein designated VGAM HOST TARGET GENE, in fact represents a plurality of VGAM46 host target genes. The mRNA of each one of this plurality of VGAM46 host target genes comprises one or more host target binding sites, each having a nucleotide sequence which is at least partly complementary to VGAM46 RNA, herein designated VGAM RNA, and which when bound by VGAM46 RNA, herein designated VGAM RNA, causes inhibition of translation of respective one or more VGAM46 host target proteins.

It is further appreciated by one skilled in the art that the mode of translational inhibition illustrated by FIG. 1 with specific reference to translational inhibition exerted by VGAM46 gene, herein designated VGAM GENE, on one or more VGAM46 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM46 is inhibition of expression of host target genes, as part of a novel viral mechanism of attacking a host. Accordingly, utilities of VGAM46 include diagnosis, prevention and treatment of viral infection by Vaccinia virus. Specific functions, and accordingly utilities, of VGAM46 correlate with, and may be deduced from, the identity of the host target genes which VGAM46 binds and inhibits, and the function of these host target genes, as elaborated hereinbelow.

Nucleotide sequences of the VGAM46 precursor RNA, herein designated VGAM PRECURSOR RNA, and of the diced VGAM46 RNA, herein designated VGAM RNA, and a schematic representation of the secondary folding of VGAM46 folded precursor RNA, herein designated VGAM FOLDED PRECURSOR RNA, of VGAM46 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM46 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 47 (VGAM47) viral gene, which modulates expression of respective host target genes thereof, the function and utility of which host target genes is known in the art.

VGAM47 is a novel bioinformatically detected regulatory, non protein coding, viral micro RNA (miRNA) gene. The method by which VGAM47 was detected is described hereinabove with reference to FIGS. 2-8.

VGAM47 gene, herein designated VGAM GENE, is a viral gene contained in the genome of Vaccinia virus. VGAM47 host target gene, herein designated VGAM HOST TARGET GENE, is a human gene contained in the human genome.

VGAM47 gene, herein designated VGAM GENE, encodes a VGAM47 precursor RNA, herein designated VGAM PRECURSOR RNA. Similar to other miRNA genes, and unlike most ordinary genes, VGAM47 precursor RNA, herein designated VGAM PRECURSOR RNA, does not encode a protein. A nucleotide sequence identical or highly similar to the nucleotide sequence of VGAM47 precursor RNA is designated SEQ ID:33, and is provided hereinbelow with reference to the sequence listing part. Nucleotide sequence SEQ ID:33 is located at position 3249 relative to the genome of Vaccinia virus.

VGAM47 precursor RNA, herein designated VGAM PRECURSOR RNA, folds onto itself, forming VGAM47 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM47 folded precursor RNA, herein designated VGAM FOLDED PRECURSOR RNA, into VGAM47 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 76%) nucleotide sequence of VGAM47 RNA is designated SEQ ID:382, and is provided hereinbelow with reference to the sequence listing part.

VGAM47 host target gene, herein designated VGAM HOST TARGET GENE, encodes a corresponding messenger RNA, VGAM47 host target RNA, herein designated VGAM HOST TARGET RNA. VGAM47 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM47 RNA, herein designated VGAM RNA, binds complementarily to one or more host target binding sites located in untranslated regions of VGAM47 host target RNA, herein designated VGAM HOST TARGET RNA. This complementary binding is due to the fact that the nucleotide sequence of VGAM47 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM47 RNA, herein designated VGAM RNA, may have a different number of host target binding sites in untranslated regions of a VGAM47 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM47 RNA, herein designated VGAM RNA, to host target binding sites on VGAM47 host target RNA, herein designated VGAM HOST TARGET RNA, such as BINDING SITE I, BINDING SITE II and BINDING SITE III, inhibits translation of VGAM47 host target RNA, herein designated VGAM HOST TARGET RNA, into VGAM47 host target protein, herein designated VGAM HOST TARGET PROTEIN. VGAM host target protein is therefore outlined by a broken line.

It is appreciated that VGAM47 host target gene, herein designated VGAM HOST TARGET GENE, in fact represents a plurality of VGAM47 host target genes. The mRNA of each one of this plurality of VGAM47 host target genes comprises one or more host target binding sites, each having a nucleotide sequence which is at least partly complementary to VGAM47 RNA, herein designated VGAM RNA, and which when bound by VGAM47 RNA, herein designated VGAM RNA, causes inhibition of translation of respective one or more VGAM47 host target proteins.

It is further appreciated by one skilled in the art that the mode of translational inhibition illustrated by FIG. 1 with specific reference to translational inhibition exerted by VGAM47 gene, herein designated VGAM GENE, on one or more VGAM47 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM47 is inhibition of expression of host target genes, as part of a novel viral mechanism of attacking a host. Accordingly, utilities of VGAM47 include diagnosis, prevention and treatment of viral infection by Vaccinia virus. Specific functions, and accordingly utilities, of VGAM47 correlate with, and may be deduced from, the identity of the host target genes which VGAM47 binds and inhibits, and the function of these host target genes, as elaborated hereinbelow.

Nucleotide sequences of the VGAM47 precursor RNA, herein designated VGAM PRECURSOR RNA, and of the diced VGAM47 RNA, herein designated VGAM RNA, and a schematic representation of the secondary folding of VGAM47 folded precursor RNA, herein designated VGAM FOLDED PRECURSOR RNA, of VGAM47 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM47 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 48 (VGAM48) viral gene, which modulates expression of respective host target genes thereof, the function and utility of which host target genes is known in the art.

VGAM48 is a novel bioinformatically detected regulatory, non protein coding, viral micro RNA (miRNA) gene. The method by which VGAM48 was detected is described hereinabove with reference to FIGS. 2-8.

VGAM48 gene, herein designated VGAM GENE, is a viral gene contained in the genome of Vaccinia virus. VGAM48 host target gene, herein designated VGAM HOST TARGET GENE, is a human gene contained in the human genome.

VGAM48 gene, herein designated VGAM GENE, encodes a VGAM48 precursor RNA, herein designated VGAM PRECURSOR RNA. Similar to other miRNA genes, and unlike most ordinary genes, VGAM48 precursor RNA, herein designated VGAM PRECURSOR RNA, does not encode a protein. A nucleotide sequence identical or highly similar to the nucleotide sequence of VGAM48 precursor RNA is designated SEQ ID:34, and is provided hereinbelow with reference to the sequence listing part. Nucleotide sequence SEQ ID:34 is located at position 3681 relative to the genome of Vaccinia virus.

VGAM48 precursor RNA, herein designated VGAM PRECURSOR RNA, folds onto itself, forming VGAM48 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM48 folded precursor RNA, herein designated VGAM FOLDED PRECURSOR RNA, into VGAM48 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM48 RNA is designated SEQ ID:383, and is provided hereinbelow with reference to the sequence listing part.

VGAM48 host target gene, herein designated VGAM HOST TARGET GENE, encodes a corresponding messenger RNA, VGAM48 host target RNA, herein designated VGAM HOST TARGET RNA. VGAM48 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM48 RNA, herein designated VGAM RNA, binds complementarily to one or more host target binding sites located in untranslated regions of VGAM48 host target RNA, herein designated VGAM HOST TARGET RNA. This complementary binding is due to the fact that the nucleotide sequence of VGAM48 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM48 RNA, herein designated VGAM RNA, may have a different number of host target binding sites in untranslated regions of a VGAM48 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM48 RNA, herein designated VGAM RNA, to host target binding sites on VGAM48 host target RNA, herein designated VGAM HOST TARGET RNA, such as BINDING SITE I, BINDING SITE II and BINDING SITE III, inhibits translation of VGAM48 host target RNA, herein designated VGAM HOST TARGET RNA, into VGAM48 host target protein, herein designated VGAM HOST TARGET PROTEIN. VGAM host target protein is therefore outlined by a broken line.

It is appreciated that VGAM48 host target gene, herein designated VGAM HOST TARGET GENE, in fact represents a plurality of VGAM48 host target genes. The mRNA of each one of this plurality of VGAM48 host target genes comprises one or more host target binding sites, each having a nucleotide sequence which is at least partly complementary to VGAM48 RNA, herein designated VGAM RNA, and which when bound by VGAM48 RNA, herein designated VGAM RNA, causes inhibition of translation of respective one or more VGAM48 host target proteins.

It is further appreciated by one skilled in the art that the mode of translational inhibition illustrated by FIG. 1 with specific reference to translational inhibition exerted by VGAM48 gene, herein designated VGAM GENE, on one or more VGAM48 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM48 is inhibition of expression of host target genes, as part of a novel viral mechanism of attacking a host. Accordingly, utilities of VGAM48 include diagnosis, prevention and treatment of viral infection by Vaccinia virus. Specific functions, and accordingly utilities, of VGAM48 correlate with, and may be deduced from, the identity of the host target genes which VGAM48 binds and inhibits, and the function of these host target genes, as elaborated hereinbelow.

Nucleotide sequences of the VGAM48 precursor RNA, herein designated VGAM PRECURSOR RNA, and of the diced VGAM48 RNA, herein designated VGAM RNA, and a schematic representation of the secondary folding of VGAM48 folded precursor RNA, herein designated VGAM FOLDED PRECURSOR RNA, of VGAM48 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM48 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 49 (VGAM49) viral gene, which modulates expression of respective host target genes thereof, the function and utility of which host target genes is known in the art.

VGAM49 is a novel bioinformatically detected regulatory, non protein coding, viral micro RNA (miRNA) gene. The method by which VGAM49 was detected is described hereinabove with reference to FIGS. 2-8.

VGAM49 gene, herein designated VGAM GENE, is a viral gene contained in the genome of Vaccinia virus. VGAM49 host target gene, herein designated VGAM HOST TARGET GENE, is a human gene contained in the human genome.

VGAM49 gene, herein designated VGAM GENE, encodes a VGAM49 precursor RNA, herein designated VGAM PRECURSOR RNA. Similar to other miRNA genes, and unlike most ordinary genes, VGAM49 precursor RNA, herein designated VGAM PRECURSOR RNA, does not encode a protein. A nucleotide sequence identical or highly similar to the nucleotide sequence of VGAM49 precursor RNA is designated SEQ ID:35, and is provided hereinbelow with reference to the sequence listing part. Nucleotide sequence SEQ ID:35 is located at position 3573 relative to the genome of Vaccinia virus.

VGAM49 precursor RNA, herein designated VGAM PRECURSOR RNA, folds onto itself, forming VGAM49 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM49 folded precursor RNA, herein designated VGAM FOLDED PRECURSOR RNA, into VGAM49 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 81%) nucleotide sequence of VGAM49 RNA is designated SEQ ID:384, and is provided hereinbelow with reference to the sequence listing part.

VGAM49 host target gene, herein designated VGAM HOST TARGET GENE, encodes a corresponding messenger RNA, VGAM49 host target RNA, herein designated VGAM HOST TARGET RNA. VGAM49 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM49 RNA, herein designated VGAM RNA, binds complementarily to one or more host target binding sites located in untranslated regions of VGAM49 host target RNA, herein designated VGAM HOST TARGET RNA. This complementary binding is due to the fact that the nucleotide sequence of VGAM49 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM49 RNA, herein designated VGAM RNA, may have a different number of host target binding sites in untranslated regions of a VGAM49 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM49 RNA, herein designated VGAM RNA, to host target binding sites on VGAM49 host target RNA, herein designated VGAM HOST TARGET RNA, such as BINDING SITE I, BINDING SITE II and BINDING SITE III, inhibits translation of VGAM49 host target RNA, herein designated VGAM HOST TARGET RNA, into VGAM49 host target protein, herein designated VGAM HOST TARGET PROTEIN. VGAM host target protein is therefore outlined by a broken line.

It is appreciated that VGAM49 host target gene, herein designated VGAM HOST TARGET GENE, in fact represents a plurality of VGAM49 host target genes. The mRNA of each one of this plurality of VGAM49 host target genes comprises one or more host target binding sites, each having a nucleotide sequence which is at least partly complementary to VGAM49 RNA, herein designated VGAM RNA, and which when bound by VGAM49 RNA, herein designated VGAM RNA, causes inhibition of translation of respective one or more VGAM49 host target proteins.

It is further appreciated by one skilled in the art that the mode of translational inhibition illustrated by FIG. 1 with specific reference to translational inhibition exerted by VGAM49 gene, herein designated VGAM GENE, on one or more VGAM49 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM49 is inhibition of expression of host target genes, as part of a novel viral mechanism of attacking a host. Accordingly, utilities of VGAM49 include diagnosis, prevention and treatment of viral infection by Vaccinia virus. Specific functions, and accordingly utilities, of VGAM49 correlate with, and may be deduced from, the identity of the host target genes which VGAM49 binds and inhibits, and the function of these host target genes, as elaborated hereinbelow.

Nucleotide sequences of the VGAM49 precursor RNA, herein designated VGAM PRECURSOR RNA, and of the diced VGAM49 RNA, herein designated VGAM RNA, and a schematic representation of the secondary folding of VGAM49 folded precursor RNA, herein designated VGAM FOLDED PRECURSOR RNA, of VGAM49 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM49 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 50 (VGAM50) viral gene, which modulates expression of respective host target genes thereof, the function and utility of which host target genes is known in the art.

VGAM50 is a novel bioinformatically detected regulatory, non protein coding, viral micro RNA (miRNA) gene. The method by which VGAM50 was detected is described hereinabove with reference to FIGS. 2-8.

VGAM50 gene, herein designated VGAM GENE, is a viral gene contained in the genome of Vaccinia virus. VGAM50 host target gene, herein designated VGAM HOST TARGET GENE, is a human gene contained in the human genome.

VGAM50 gene, herein designated VGAM GENE, encodes a VGAM50 precursor RNA, herein designated VGAM PRECURSOR RNA. Similar to other miRNA genes, and unlike most ordinary genes, VGAM50 precursor RNA, herein designated VGAM PRECURSOR RNA, does not encode a protein. A nucleotide sequence identical or highly similar to the nucleotide sequence of VGAM50 precursor RNA is designated SEQ ID:36, and is provided hereinbelow with reference to the sequence listing part. Nucleotide sequence SEQ ID:36 is located at position 2870 relative to the genome of Vaccinia virus.

VGAM50 precursor RNA, herein designated VGAM PRECURSOR RNA, folds onto itself, forming VGAM50 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM50 folded precursor RNA, herein designated VGAM FOLDED PRECURSOR RNA, into VGAM50 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 81%) nucleotide sequence of VGAM50 RNA is designated SEQ ID:385, and is provided hereinbelow with reference to the sequence listing part.

VGAM50 host target gene, herein designated VGAM HOST TARGET GENE, encodes a corresponding messenger RNA, VGAM50 host target RNA, herein designated VGAM HOST TARGET RNA. VGAM50 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM50 RNA, herein designated VGAM RNA, binds complementarily to one or more host target binding sites located in untranslated regions of VGAM50 host target RNA, herein designated VGAM HOST TARGET RNA. This complementary binding is due to the fact that the nucleotide sequence of VGAM50 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM50 RNA, herein designated VGAM RNA, may have a different number of host target binding sites in untranslated regions of a VGAM50 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM50 RNA, herein designated VGAM RNA, to host target binding sites on VGAM50 host target RNA, herein designated VGAM HOST TARGET RNA, such as BINDING SITE I, BINDING SITE II and BINDING SITE III, inhibits translation of VGAM50 host target RNA, herein designated VGAM HOST TARGET RNA, into VGAM50 host target protein, herein designated VGAM HOST TARGET PROTEIN. VGAM host target protein is therefore outlined by a broken line.

It is appreciated that VGAM50 host target gene, herein designated VGAM HOST TARGET GENE, in fact represents a plurality of VGAM50 host target genes. The mRNA of each one of this plurality of VGAM50 host target genes comprises one or more host target binding sites, each having a nucleotide sequence which is at least partly complementary to VGAM50 RNA, herein designated VGAM RNA, and which when bound by VGAM50 RNA, herein designated VGAM RNA, causes inhibition of translation of respective one or more VGAM50 host target proteins.

It is further appreciated by one skilled in the art that the mode of translational inhibition illustrated by FIG. 1 with specific reference to translational inhibition exerted by VGAM50 gene, herein designated VGAM GENE, on one or more VGAM50 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM50 is inhibition of expression of host target genes, as part of a novel viral mechanism of attacking a host. Accordingly, utilities of VGAM50 include diagnosis, prevention and treatment of viral infection by Vaccinia virus. Specific functions, and accordingly utilities, of VGAM50 correlate with, and may be deduced from, the identity of the host target genes which VGAM50 binds and inhibits, and the function of these host target genes, as elaborated hereinbelow.

Nucleotide sequences of the VGAM50 precursor RNA, herein designated VGAM PRECURSOR RNA, and of the diced VGAM50 RNA, herein designated VGAM RNA, and a schematic representation of the secondary folding of VGAM50 folded precursor RNA, herein designated VGAM FOLDED PRECURSOR RNA, of VGAM50 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM50 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 51 (VGAM51) viral gene, which modulates expression of respective host target genes thereof, the function and utility of which host target genes is known in the art.

VGAM51 is a novel bioinformatically detected regulatory, non protein coding, viral micro RNA (miRNA) gene. The method by which VGAM51 was detected is described hereinabove with reference to FIGS. 2-8.

VGAM51 gene, herein designated VGAM GENE, is a viral gene contained in the genome of Vaccinia virus. VGAM51 host target gene, herein designated VGAM HOST TARGET GENE, is a human gene contained in the human genome.

VGAM51 gene, herein designated VGAM GENE, encodes a VGAM51 precursor RNA, herein designated VGAM PRECURSOR RNA. Similar to other miRNA genes, and unlike most ordinary genes, VGAM51 precursor RNA, herein designated VGAM PRECURSOR RNA, does not encode a protein. A nucleotide sequence identical or highly similar to the nucleotide sequence of VGAM51 precursor RNA is designated SEQ ID:37, and is provided hereinbelow with reference to the sequence listing part. Nucleotide sequence SEQ ID:37 is located at position 6123 relative to the genome of Vaccinia virus.

VGAM51 precursor RNA, herein designated VGAM PRECURSOR RNA, folds onto itself, forming VGAM51 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM51 folded precursor RNA, herein designated VGAM FOLDED PRECURSOR RNA, into VGAM51 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM51 RNA is designated SEQ ID:386, and is provided hereinbelow with reference to the sequence listing part.

VGAM51 host target gene, herein designated VGAM HOST TARGET GENE, encodes a corresponding messenger RNA, VGAM51 host target RNA, herein designated VGAM HOST TARGET RNA. VGAM51 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM51 RNA, herein designated VGAM RNA, binds complementarily to one or more host target binding sites located in untranslated regions of VGAM51 host target RNA, herein designated VGAM HOST TARGET RNA. This complementary binding is due to the fact that the nucleotide sequence of VGAM51 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM51 RNA, herein designated VGAM RNA, may have a different number of host target binding sites in untranslated regions of a VGAM51 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM51 RNA, herein designated VGAM RNA, to host target binding sites on VGAM51 host target RNA, herein designated VGAM HOST TARGET RNA, such as BINDING SITE I, BINDING SITE II and BINDING SITE III, inhibits translation of VGAM51 host target RNA, herein designated VGAM HOST TARGET RNA, into VGAM51 host target protein, herein designated VGAM HOST TARGET PROTEIN. VGAM host target protein is therefore outlined by a broken line.

It is appreciated that VGAM51 host target gene, herein designated VGAM HOST TARGET GENE, in fact represents a plurality of VGAM51 host target genes. The mRNA of each one of this plurality of VGAM51 host target genes comprises one or more host target binding sites, each having a nucleotide sequence which is at least partly complementary to VGAM51 RNA, herein designated VGAM RNA, and which when bound by VGAM51 RNA, herein designated VGAM RNA, causes inhibition of translation of respective one or more VGAM51 host target proteins.

It is further appreciated by one skilled in the art that the mode of translational inhibition illustrated by FIG. 1 with specific reference to translational inhibition exerted by VGAM51 gene, herein designated VGAM GENE, on one or more VGAM51 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM51 is inhibition of expression of host target genes, as part of a novel viral mechanism of attacking a host. Accordingly, utilities of VGAM51 include diagnosis, prevention and treatment of viral infection by Vaccinia virus. Specific functions, and accordingly utilities, of VGAM51 correlate with, and may be deduced from, the identity of the host target genes which VGAM51 binds and inhibits, and the function of these host target genes, as elaborated hereinbelow.

Nucleotide sequences of the VGAM51 precursor RNA, herein designated VGAM PRECURSOR RNA, and of the diced VGAM51 RNA, herein designated VGAM RNA, and a schematic representation of the secondary folding of VGAM51 folded precursor RNA, herein designated VGAM FOLDED PRECURSOR RNA, of VGAM51 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM51 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 52 (VGAM52) viral gene, which modulates expression of respective host target genes thereof, the function and utility of which host target genes is known in the art.

VGAM52 is a novel bioinformatically detected regulatory, non protein coding, viral micro RNA (miRNA) gene. The method by which VGAM52 was detected is described hereinabove with reference to FIGS. 2-8.

VGAM52 gene, herein designated VGAM GENE, is a viral gene contained in the genome of Vaccinia virus. VGAM52 host target gene, herein designated VGAM HOST TARGET GENE, is a human gene contained in the human genome.

VGAM52 gene, herein designated VGAM GENE, encodes a VGAM52 precursor RNA, herein designated VGAM PRECURSOR RNA. Similar to other miRNA genes, and unlike most ordinary genes, VGAM52 precursor RNA, herein designated VGAM PRECURSOR RNA, does not encode a protein. A nucleotide sequence identical or highly similar to the nucleotide sequence of VGAM52 precursor RNA is designated SEQ ID:38, and is provided hereinbelow with reference to the sequence listing part. Nucleotide sequence SEQ ID:38 is located at position 6573 relative to the genome of Vaccinia virus.

VGAM52 precursor RNA, herein designated VGAM PRECURSOR RNA, folds onto itself, forming VGAM52 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM52 folded precursor RNA, herein designated VGAM FOLDED PRECURSOR RNA, into VGAM52 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM52 RNA is designated SEQ ID:387, and is provided hereinbelow with reference to the sequence listing part.

VGAM52 host target gene, herein designated VGAM HOST TARGET GENE, encodes a corresponding messenger RNA, VGAM52 host target RNA, herein designated VGAM HOST TARGET RNA. VGAM52 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM52 RNA, herein designated VGAM RNA, binds complementarily to one or more host target binding sites located in untranslated regions of VGAM52 host target RNA, herein designated VGAM HOST TARGET RNA. This complementary binding is due to the fact that the nucleotide sequence of VGAM52 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM52 RNA, herein designated VGAM RNA, may have a different number of host target binding sites in untranslated regions of a VGAM52 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM52 RNA, herein designated VGAM RNA, to host target binding sites on VGAM52 host target RNA, herein designated VGAM HOST TARGET RNA, such as BINDING SITE I, BINDING SITE II and BINDING SITE III, inhibits translation of VGAM52 host target RNA, herein designated VGAM HOST TARGET RNA, into VGAM52 host target protein, herein designated VGAM HOST TARGET PROTEIN. VGAM host target protein is therefore outlined by a broken line.

It is appreciated that VGAM52 host target gene, herein designated VGAM HOST TARGET GENE, in fact represents a plurality of VGAM52 host target genes. The mRNA of each one of this plurality of VGAM52 host target genes comprises one or more host target binding sites, each having a nucleotide sequence which is at least partly complementary to VGAM52 RNA, herein designated VGAM RNA, and which when bound by VGAM52 RNA, herein designated VGAM RNA, causes inhibition of translation of respective one or more VGAM52 host target proteins.

It is further appreciated by one skilled in the art that the mode of translational inhibition illustrated by FIG. 1 with specific reference to translational inhibition exerted by VGAM52 gene, herein designated VGAM GENE, on one or more VGAM52 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM52 is inhibition of expression of host target genes, as part of a novel viral mechanism of attacking a host. Accordingly, utilities of VGAM52 include diagnosis, prevention and treatment of viral infection by Vaccinia virus. Specific functions, and accordingly utilities, of VGAM52 correlate with, and may be deduced from, the identity of the host target genes which VGAM52 binds and inhibits, and the function of these host target genes, as elaborated hereinbelow.

Nucleotide sequences of the VGAM52 precursor RNA, herein designated VGAM PRECURSOR RNA, and of the diced VGAM52 RNA, herein designated VGAM RNA, and a schematic representation of the secondary folding of VGAM52 folded precursor RNA, herein designated VGAM FOLDED PRECURSOR RNA, of VGAM52 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM52 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 53 (VGAM53) viral gene, which modulates expression of respective host target genes thereof, the function and utility of which host target genes is known in the art.

VGAM53 is a novel bioinformatically detected regulatory, non protein coding, viral micro RNA (miRNA) gene. The method by which VGAM53 was detected is described hereinabove with reference to FIGS. 2-8.

VGAM53 gene, herein designated VGAM GENE, is a viral gene contained in the genome of Vaccinia virus. VGAM53 host target gene, herein designated VGAM HOST TARGET GENE, is a human gene contained in the human genome.

VGAM53 gene, herein designated VGAM GENE, encodes a VGAM53 precursor RNA, herein designated VGAM PRECURSOR RNA. Similar to other miRNA genes, and unlike most ordinary genes, VGAM53 precursor RNA, herein designated VGAM PRECURSOR RNA, does not encode a protein. A nucleotide sequence identical or highly similar to the nucleotide sequence of VGAM53 precursor RNA is designated SEQ ID:39, and is provided hereinbelow with reference to the sequence listing part. Nucleotide sequence SEQ ID:39 is located at position 5257 relative to the genome of Vaccinia virus.

VGAM53 precursor RNA, herein designated VGAM PRECURSOR RNA, folds onto itself, forming VGAM53 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM53 folded precursor RNA, herein designated VGAM FOLDED PRECURSOR RNA, into VGAM53 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM53 RNA is designated SEQ ID:388, and is provided hereinbelow with reference to the sequence listing part.

VGAM53 host target gene, herein designated VGAM HOST TARGET GENE, encodes a corresponding messenger RNA, VGAM53 host target RNA, herein designated VGAM HOST TARGET RNA. VGAM53 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM53 RNA, herein designated VGAM RNA, binds complementarily to one or more host target binding sites located in untranslated regions of VGAM53 host target RNA, herein designated VGAM HOST TARGET RNA. This complementary binding is due to the fact that the nucleotide sequence of VGAM53 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM53 RNA, herein designated VGAM RNA, may have a different number of host target binding sites in untranslated regions of a VGAM53 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM53 RNA, herein designated VGAM RNA, to host target binding sites on VGAM53 host target RNA, herein designated VGAM HOST TARGET RNA, such as BINDING SITE I, BINDING SITE II and BINDING SITE III, inhibits translation of VGAM53 host target RNA, herein designated VGAM HOST TARGET RNA, into VGAM53 host target protein, herein designated VGAM HOST TARGET PROTEIN. VGAM host target protein is therefore outlined by a broken line.

It is appreciated that VGAM53 host target gene, herein designated VGAM HOST TARGET GENE, in fact represents a plurality of VGAM53 host target genes. The mRNA of each one of this plurality of VGAM53 host target genes comprises one or more host target binding sites, each having a nucleotide sequence which is at least partly complementary to VGAM53 RNA, herein designated VGAM RNA, and which when bound by VGAM53 RNA, herein designated VGAM RNA, causes inhibition of translation of respective one or more VGAM53 host target proteins.

It is further appreciated by one skilled in the art that the mode of translational inhibition illustrated by FIG. 1 with specific reference to translational inhibition exerted by VGAM53 gene, herein designated VGAM GENE, on one or more VGAM53 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM53 is inhibition of expression of host target genes, as part of a novel viral mechanism of attacking a host. Accordingly, utilities of VGAM53 include diagnosis, prevention and treatment of viral infection by Vaccinia virus. Specific functions, and accordingly utilities, of VGAM53 correlate with, and may be deduced from, the identity of the host target genes which VGAM53 binds and inhibits, and the function of these host target genes, as elaborated hereinbelow.

Nucleotide sequences of the VGAM53 precursor RNA, herein designated VGAM PRECURSOR RNA, and of the diced VGAM53 RNA, herein designated VGAM RNA, and a schematic representation of the secondary folding of VGAM53 folded precursor RNA, herein designated VGAM FOLDED PRECURSOR RNA, of VGAM53 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM53 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 54 (VGAM54) viral gene, which modulates expression of respective host target genes thereof, the function and utility of which host target genes is known in the art.

VGAM54 is a novel bioinformatically detected regulatory, non protein coding, viral micro RNA (miRNA) gene. The method by which VGAM54 was detected is described hereinabove with reference to FIGS. 2-8.

VGAM54 gene, herein designated VGAM GENE, is a viral gene contained in the genome of Vaccinia virus. VGAM54 host target gene, herein designated VGAM HOST TARGET GENE, is a human gene contained in the human genome.

VGAM54 gene, herein designated VGAM GENE, encodes a VGAM54 precursor RNA, herein designated VGAM PRECURSOR RNA. Similar to other miRNA genes, and unlike most ordinary genes, VGAM54 precursor RNA, herein designated VGAM PRECURSOR RNA, does not encode a protein. A nucleotide sequence identical or highly similar to the nucleotide sequence of VGAM54 precursor RNA is designated SEQ ID:40, and is provided hereinbelow with reference to the sequence listing part. Nucleotide sequence SEQ ID:40 is located at position 4867 relative to the genome of Vaccinia virus.

VGAM54 precursor RNA, herein designated VGAM PRECURSOR RNA, folds onto itself, forming VGAM54 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM54 folded precursor RNA, herein designated VGAM FOLDED PRECURSOR RNA, into VGAM54 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM54 RNA is designated SEQ ID:389, and is provided hereinbelow with reference to the sequence listing part.

VGAM54 host target gene, herein designated VGAM HOST TARGET GENE, encodes a corresponding messenger RNA, VGAM54 host target RNA, herein designated VGAM HOST TARGET RNA. VGAM54 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM54 RNA, herein designated VGAM RNA, binds complementarily to one or more host target binding sites located in untranslated regions of VGAM54 host target RNA, herein designated VGAM HOST TARGET RNA. This complementary binding is due to the fact that the nucleotide sequence of VGAM54 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM54 RNA, herein designated VGAM RNA, may have a different number of host target binding sites in untranslated regions of a VGAM54 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM54 RNA, herein designated VGAM RNA, to host target binding sites on VGAM54 host target RNA, herein designated VGAM HOST TARGET RNA, such as BINDING SITE I, BINDING SITE II and BINDING SITE III, inhibits translation of VGAM54 host target RNA, herein designated VGAM HOST TARGET RNA, into VGAM54 host target protein, herein designated VGAM HOST TARGET PROTEIN. VGAM host target protein is therefore outlined by a broken line.

It is appreciated that VGAM54 host target gene, herein designated VGAM HOST TARGET GENE, in fact represents a plurality of VGAM54 host target genes. The mRNA of each one of this plurality of VGAM54 host target genes comprises one or more host target binding sites, each having a nucleotide sequence which is at least partly complementary to VGAM54 RNA, herein designated VGAM RNA, and which when bound by VGAM54 RNA, herein designated VGAM RNA, causes inhibition of translation of respective one or more VGAM54 host target proteins.

It is further appreciated by one skilled in the art that the mode of translational inhibition illustrated by FIG. 1 with specific reference to translational inhibition exerted by VGAM54 gene, herein designated VGAM GENE, on one or more VGAM54 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM54 is inhibition of expression of host target genes, as part of a novel viral mechanism of attacking a host. Accordingly, utilities of VGAM54 include diagnosis, prevention and treatment of viral infection by Vaccinia virus. Specific functions, and accordingly utilities, of VGAM54 correlate with, and may be deduced from, the identity of the host target genes which VGAM54 binds and inhibits, and the function of these host target genes, as elaborated hereinbelow.

Nucleotide sequences of the VGAM54 precursor RNA, herein designated VGAM PRECURSOR RNA, and of the diced VGAM54 RNA, herein designated VGAM RNA, and a schematic representation of the secondary folding of VGAM54 folded precursor RNA, herein designated VGAM FOLDED PRECURSOR RNA, of VGAM54 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM54 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 55 (VGAM55) viral gene, which modulates expression of respective host target genes thereof, the function and utility of which host target genes is known in the art.

VGAM55 is a novel bioinformatically detected regulatory, non protein coding, viral micro RNA (miRNA) gene. The method by which VGAM55 was detected is described hereinabove with reference to FIGS. 2-8.

VGAM55 gene, herein designated VGAM GENE, is a viral gene contained in the genome of Vaccinia virus. VGAM55 host target gene, herein designated VGAM HOST TARGET GENE, is a human gene contained in the human genome.

VGAM55 gene, herein designated VGAM GENE, encodes a VGAM55 precursor RNA, herein designated VGAM PRECURSOR RNA. Similar to other miRNA genes, and unlike most ordinary genes, VGAM55 precursor RNA, herein designated VGAM PRECURSOR RNA, does not encode a protein. A nucleotide sequence identical or highly similar to the nucleotide sequence of VGAM55 precursor RNA is designated SEQ ID:41, and is provided hereinbelow with reference to the sequence listing part. Nucleotide sequence SEQ ID:41 is located at position 185510 relative to the genome of Vaccinia virus.

VGAM55 precursor RNA, herein designated VGAM PRECURSOR RNA, folds onto itself, forming VGAM55 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM55 folded precursor RNA, herein designated VGAM FOLDED PRECURSOR RNA, into VGAM55 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 87%) nucleotide sequence of VGAM55 RNA is designated SEQ ID:390, and is provided hereinbelow with reference to the sequence listing part.

VGAM55 host target gene, herein designated VGAM HOST TARGET GENE, encodes a corresponding messenger RNA, VGAM55 host target RNA, herein designated VGAM HOST TARGET RNA. VGAM55 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM55 RNA, herein designated VGAM RNA, binds complementarily to one or more host target binding sites located in untranslated regions of VGAM55 host target RNA, herein designated VGAM HOST TARGET RNA. This complementary binding is due to the fact that the nucleotide sequence of VGAM55 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM55 RNA, herein designated VGAM RNA, may have a different number of host target binding sites in untranslated regions of a VGAM55 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM55 RNA, herein designated VGAM RNA, to host target binding sites on VGAM55 host target RNA, herein designated VGAM HOST TARGET RNA, such as BINDING SITE I, BINDING SITE II and BINDING SITE III, inhibits translation of VGAM55 host target RNA, herein designated VGAM HOST TARGET RNA, into VGAM55 host target protein, herein designated VGAM HOST TARGET PROTEIN. VGAM host target protein is therefore outlined by a broken line.

It is appreciated that VGAM55 host target gene, herein designated VGAM HOST TARGET GENE, in fact represents a plurality of VGAM55 host target genes. The mRNA of each one of this plurality of VGAM55 host target genes comprises one or more host target binding sites, each having a nucleotide sequence which is at least partly complementary to VGAM55 RNA, herein designated VGAM RNA, and which when bound by VGAM55 RNA, herein designated VGAM RNA, causes inhibition of translation of respective one or more VGAM55 host target proteins.

It is further appreciated by one skilled in the art that the mode of translational inhibition illustrated by FIG. 1 with specific reference to translational inhibition exerted by VGAM55 gene, herein designated VGAM GENE, on one or more VGAM55 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM55 is inhibition of expression of host target genes, as part of a novel viral mechanism of attacking a host. Accordingly, utilities of VGAM55 include diagnosis, prevention and treatment of viral infection by Vaccinia virus. Specific functions, and accordingly utilities, of VGAM55 correlate with, and may be deduced from, the identity of the host target genes which VGAM55 binds and inhibits, and the function of these host target genes, as elaborated hereinbelow.

Nucleotide sequences of the VGAM55 precursor RNA, herein designated VGAM PRECURSOR RNA, and of the diced VGAM55 RNA, herein designated VGAM RNA, and a schematic representation of the secondary folding of VGAM55 folded precursor RNA, herein designated VGAM FOLDED PRECURSOR RNA, of VGAM55 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM55 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 56 (VGAM56) viral gene, which modulates expression of respective host target genes thereof, the function and utility of which host target genes is known in the art.

VGAM56 is a novel bioinformatically detected regulatory, non protein coding, viral micro RNA (miRNA) gene. The method by which VGAM56 was detected is described hereinabove with reference to FIGS. 2-8.

VGAM56 gene, herein designated VGAM GENE, is a viral gene contained in the genome of Vaccinia virus. VGAM56 host target gene, herein designated VGAM HOST TARGET GENE, is a human gene contained in the human genome.

VGAM56 gene, herein designated VGAM GENE, encodes a VGAM56 precursor RNA, herein designated VGAM PRECURSOR RNA. Similar to other miRNA genes, and unlike most ordinary genes, VGAM56 precursor RNA, herein designated VGAM PRECURSOR RNA, does not encode a protein. A nucleotide sequence identical or highly similar to the nucleotide sequence of VGAM56 precursor RNA is designated SEQ ID:42, and is provided hereinbelow with reference to the sequence listing part. Nucleotide sequence SEQ ID:42 is located at position 183817 relative to the genome of Vaccinia virus.

VGAM56 precursor RNA, herein designated VGAM PRECURSOR RNA, folds onto itself, forming VGAM56 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM56 folded precursor RNA, herein designated VGAM FOLDED PRECURSOR RNA, into VGAM56 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM56 RNA is designated SEQ ID:391, and is provided hereinbelow with reference to the sequence listing part.

VGAM56 host target gene, herein designated VGAM HOST TARGET GENE, encodes a corresponding messenger RNA, VGAM56 host target RNA, herein designated VGAM HOST TARGET RNA. VGAM56 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM56 RNA, herein designated VGAM RNA, binds complementarily to one or more host target binding sites located in untranslated regions of VGAM56 host target RNA, herein designated VGAM HOST TARGET RNA. This complementary binding is due to the fact that the nucleotide sequence of VGAM56 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM56 RNA, herein designated VGAM RNA, may have a different number of host target binding sites in untranslated regions of a VGAM56 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM56 RNA, herein designated VGAM RNA, to host target binding sites on VGAM56 host target RNA, herein designated VGAM HOST TARGET RNA, such as BINDING SITE I, BINDING SITE II and BINDING SITE III, inhibits translation of VGAM56 host target RNA, herein designated VGAM HOST TARGET RNA, into VGAM56 host target protein, herein designated VGAM HOST TARGET PROTEIN. VGAM host target protein is therefore outlined by a broken line.

It is appreciated that VGAM56 host target gene, herein designated VGAM HOST TARGET GENE, in fact represents a plurality of VGAM56 host target genes. The mRNA of each one of this plurality of VGAM56 host target genes comprises one or more host target binding sites, each having a nucleotide sequence which is at least partly complementary to VGAM56 RNA, herein designated VGAM RNA, and which when bound by VGAM56 RNA, herein designated VGAM RNA, causes inhibition of translation of respective one or more VGAM56 host target proteins.

It is further appreciated by one skilled in the art that the mode of translational inhibition illustrated by FIG. 1 with specific reference to translational inhibition exerted by VGAM56 gene, herein designated VGAM GENE, on one or more VGAM56 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM56 is inhibition of expression of host target genes, as part of a novel viral mechanism of attacking a host. Accordingly, utilities of VGAM56 include diagnosis, prevention and treatment of viral infection by Vaccinia virus. Specific functions, and accordingly utilities, of VGAM56 correlate with, and may be deduced from, the identity of the host target genes which VGAM56 binds and inhibits, and the function of these host target genes, as elaborated hereinbelow.

Nucleotide sequences of the VGAM56 precursor RNA, herein designated VGAM PRECURSOR RNA, and of the diced VGAM56 RNA, herein designated VGAM RNA, and a schematic representation of the secondary folding of VGAM56 folded precursor RNA, herein designated VGAM FOLDED PRECURSOR RNA, of VGAM56 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM56 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 57 (VGAM57) viral gene, which modulates expression of respective host target genes thereof, the function and utility of which host target genes is known in the art.

VGAM57 is a novel bioinformatically detected regulatory, non protein coding, viral micro RNA (miRNA) gene. The method by which VGAM57 was detected is described hereinabove with reference to FIGS. 2-8.

VGAM57 gene, herein designated VGAM GENE, is a viral gene contained in the genome of Vaccinia virus. VGAM57 host target gene, herein designated VGAM HOST TARGET GENE, is a human gene contained in the human genome.

VGAM57 gene, herein designated VGAM GENE, encodes a VGAM57 precursor RNA, herein designated VGAM PRECURSOR RNA. Similar to other miRNA genes, and unlike most ordinary genes, VGAM57 precursor RNA, herein designated VGAM PRECURSOR RNA, does not encode a protein. A nucleotide sequence identical or highly similar to the nucleotide sequence of VGAM57 precursor RNA is designated SEQ ID:43, and is provided hereinbelow with reference to the sequence listing part. Nucleotide sequence SEQ ID:43 is located at position 183735 relative to the genome of Vaccinia virus.

VGAM57 precursor RNA, herein designated VGAM PRECURSOR RNA, folds onto itself, forming VGAM57 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM57 folded precursor RNA, herein designated VGAM FOLDED PRECURSOR RNA, into VGAM57 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 71%) nucleotide sequence of VGAM57 RNA is designated SEQ ID:392, and is provided hereinbelow with reference to the sequence listing part.

VGAM57 host target gene, herein designated VGAM HOST TARGET GENE, encodes a corresponding messenger RNA, VGAM57 host target RNA, herein designated VGAM HOST TARGET RNA. VGAM57 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM57 RNA, herein designated VGAM RNA, binds complementarily to one or more host target binding sites located in untranslated regions of VGAM57 host target RNA, herein designated VGAM HOST TARGET RNA. This complementary binding is due to the fact that the nucleotide sequence of VGAM57 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM57 RNA, herein designated VGAM RNA, may have a different number of host target binding sites in untranslated regions of a VGAM57 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM57 RNA, herein designated VGAM RNA, to host target binding sites on VGAM57 host target RNA, herein designated VGAM HOST TARGET RNA, such as BINDING SITE I, BINDING SITE II and BINDING SITE III, inhibits translation of VGAM57 host target RNA, herein designated VGAM HOST TARGET RNA, into VGAM57 host target protein, herein designated VGAM HOST TARGET PROTEIN. VGAM host target protein is therefore outlined by a broken line.

It is appreciated that VGAM57 host target gene, herein designated VGAM HOST TARGET GENE, in fact represents a plurality of VGAM57 host target genes. The mRNA of each one of this plurality of VGAM57 host target genes comprises one or more host target binding sites, each having a nucleotide sequence which is at least partly complementary to VGAM57 RNA, herein designated VGAM RNA, and which when bound by VGAM57 RNA, herein designated VGAM RNA, causes inhibition of translation of respective one or more VGAM57 host target proteins.

It is further appreciated by one skilled in the art that the mode of translational inhibition illustrated by FIG. 1 with specific reference to translational inhibition exerted by VGAM57 gene, herein designated VGAM GENE, on one or more VGAM57 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM57 is inhibition of expression of host target genes, as part of a novel viral mechanism of attacking a host. Accordingly, utilities of VGAM57 include diagnosis, prevention and treatment of viral infection by Vaccinia virus. Specific functions, and accordingly utilities, of VGAM57 correlate with, and may be deduced from, the identity of the host target genes which VGAM57 binds and inhibits, and the function of these host target genes, as elaborated hereinbelow.

Nucleotide sequences of the VGAM57 precursor RNA, herein designated VGAM PRECURSOR RNA, and of the diced VGAM57 RNA, herein designated VGAM RNA, and a schematic representation of the secondary folding of VGAM57 folded precursor RNA, herein designated VGAM FOLDED PRECURSOR RNA, of VGAM57 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM57 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 58 (VGAM58) viral gene, which modulates expression of respective host target genes thereof, the function and utility of which host target genes is known in the art.

VGAM58 is a novel bioinformatically detected regulatory, non protein coding, viral micro RNA (miRNA) gene. The method by which VGAM58 was detected is described hereinabove with reference to FIGS. 2-8.

VGAM58 gene, herein designated VGAM GENE, is a viral gene contained in the genome of Vaccinia virus. VGAM58 host target gene, herein designated VGAM HOST TARGET GENE, is a human gene contained in the human genome.

VGAM58 gene, herein designated VGAM GENE, encodes a VGAM58 precursor RNA, herein designated VGAM PRECURSOR RNA. Similar to other miRNA genes, and unlike most ordinary genes, VGAM58 precursor RNA, herein designated VGAM PRECURSOR RNA, does not encode a protein. A nucleotide sequence identical or highly similar to the nucleotide sequence of VGAM58 precursor RNA is designated SEQ ID:44, and is provided hereinbelow with reference to the sequence listing part. Nucleotide sequence SEQ ID:44 is located at position 9636 relative to the genome of Vaccinia virus.

VGAM58 precursor RNA, herein designated VGAM PRECURSOR RNA, folds onto itself, forming VGAM58 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM58 folded precursor RNA, herein designated VGAM FOLDED PRECURSOR RNA, into VGAM58 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 71%) nucleotide sequence of VGAM58 RNA is designated SEQ ID:393, and is provided hereinbelow with reference to the sequence listing part.

VGAM58 host target gene, herein designated VGAM HOST TARGET GENE, encodes a corresponding messenger RNA, VGAM58 host target RNA, herein designated VGAM HOST TARGET RNA. VGAM58 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM58 RNA, herein designated VGAM RNA, binds complementarily to one or more host target binding sites located in untranslated regions of VGAM58 host target RNA, herein designated VGAM HOST TARGET RNA. This complementary binding is due to the fact that the nucleotide sequence of VGAM58 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM58 RNA, herein designated VGAM RNA, may have a different number of host target binding sites in untranslated regions of a VGAM58 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM58 RNA, herein designated VGAM RNA, to host target binding sites on VGAM58 host target RNA, herein designated VGAM HOST TARGET RNA, such as BINDING SITE I, BINDING SITE II and BINDING SITE III, inhibits translation of VGAM58 host target RNA, herein designated VGAM HOST TARGET RNA, into VGAM58 host target protein, herein designated VGAM HOST TARGET PROTEIN. VGAM host target protein is therefore outlined by a broken line.

It is appreciated that VGAM58 host target gene, herein designated VGAM HOST TARGET GENE, in fact represents a plurality of VGAM58 host target genes. The mRNA of each one of this plurality of VGAM58 host target genes comprises one or more host target binding sites, each having a nucleotide sequence which is at least partly complementary to VGAM58 RNA, herein designated VGAM RNA, and which when bound by VGAM58 RNA, herein designated VGAM RNA, causes inhibition of translation of respective one or more VGAM58 host target proteins.

It is further appreciated by one skilled in the art that the mode of translational inhibition illustrated by FIG. 1 with specific reference to translational inhibition exerted by VGAM58 gene, herein designated VGAM GENE, on one or more VGAM58 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM58 is inhibition of expression of host target genes, as part of a novel viral mechanism of attacking a host. Accordingly, utilities of VGAM58 include diagnosis, prevention and treatment of viral infection by Vaccinia virus. Specific functions, and accordingly utilities, of VGAM58 correlate with, and may be deduced from, the identity of the host target genes which VGAM58 binds and inhibits, and the function of these host target genes, as elaborated hereinbelow.

Nucleotide sequences of the VGAM58 precursor RNA, herein designated VGAM PRECURSOR RNA, and of the diced VGAM58 RNA, herein designated VGAM RNA, and a schematic representation of the secondary folding of VGAM58 folded precursor RNA, herein designated VGAM FOLDED PRECURSOR RNA, of VGAM58 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM58 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 59 (VGAM59) viral gene, which modulates expression of respective host target genes thereof, the function and utility of which host target genes is known in the art.

VGAM59 is a novel bioinformatically detected regulatory, non protein coding, viral micro RNA (miRNA) gene. The method by which VGAM59 was detected is described hereinabove with reference to FIGS. 2-8.

VGAM59 gene, herein designated VGAM GENE, is a viral gene contained in the genome of Vaccinia virus. VGAM59 host target gene, herein designated VGAM HOST TARGET GENE, is a human gene contained in the human genome.

VGAM59 gene, herein designated VGAM GENE, encodes a VGAM59 precursor RNA, herein designated VGAM PRECURSOR RNA. Similar to other miRNA genes, and unlike most ordinary genes, VGAM59 precursor RNA, herein designated VGAM PRECURSOR RNA, does not encode a protein. A nucleotide sequence identical or highly similar to the nucleotide sequence of VGAM59 precursor RNA is designated SEQ ID:45, and is provided hereinbelow with reference to the sequence listing part. Nucleotide sequence SEQ ID:45 is located at position 13536 relative to the genome of Vaccinia virus.

VGAM59 precursor RNA, herein designated VGAM PRECURSOR RNA, folds onto itself, forming VGAM59 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM59 folded precursor RNA, herein designated VGAM FOLDED PRECURSOR RNA, into VGAM59 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 88%) nucleotide sequence of VGAM59 RNA is designated SEQ ID:394, and is provided hereinbelow with reference to the sequence listing part.

VGAM59 host target gene, herein designated VGAM HOST TARGET GENE, encodes a corresponding messenger RNA, VGAM59 host target RNA, herein designated VGAM HOST TARGET RNA. VGAM59 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM59 RNA, herein designated VGAM RNA, binds complementarily to one or more host target binding sites located in untranslated regions of VGAM59 host target RNA, herein designated VGAM HOST TARGET RNA. This complementary binding is due to the fact that the nucleotide sequence of VGAM59 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM59 RNA, herein designated VGAM RNA, may have a different number of host target binding sites in untranslated regions of a VGAM59 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM59 RNA, herein designated VGAM RNA, to host target binding sites on VGAM59 host target RNA, herein designated VGAM HOST TARGET RNA, such as BINDING SITE I, BINDING SITE II and BINDING SITE III, inhibits translation of VGAM59 host target RNA, herein designated VGAM HOST TARGET RNA, into VGAM59 host target protein, herein designated VGAM HOST TARGET PROTEIN. VGAM host target protein is therefore outlined by a broken line.

It is appreciated that VGAM59 host target gene, herein designated VGAM HOST TARGET GENE, in fact represents a plurality of VGAM59 host target genes. The mRNA of each one of this plurality of VGAM59 host target genes comprises one or more host target binding sites, each having a nucleotide sequence which is at least partly complementary to VGAM59 RNA, herein designated VGAM RNA, and which when bound by VGAM59 RNA, herein designated VGAM RNA, causes inhibition of translation of respective one or more VGAM59 host target proteins.

It is further appreciated by one skilled in the art that the mode of translational inhibition illustrated by FIG. 1 with specific reference to translational inhibition exerted by VGAM59 gene, herein designated VGAM GENE, on one or more VGAM59 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM59 is inhibition of expression of host target genes, as part of a novel viral mechanism of attacking a host. Accordingly, utilities of VGAM59 include diagnosis, prevention and treatment of viral infection by Vaccinia virus. Specific functions, and accordingly utilities, of VGAM59 correlate with, and may be deduced from, the identity of the host target genes which VGAM59 binds and inhibits, and the function of these host target genes, as elaborated hereinbelow.

Nucleotide sequences of the VGAM59 precursor RNA, herein designated VGAM PRECURSOR RNA, and of the diced VGAM59 RNA, herein designated VGAM RNA, and a schematic representation of the secondary folding of VGAM59 folded precursor RNA, herein designated VGAM FOLDED PRECURSOR RNA, of VGAM59 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM59 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 60 (VGAM60) viral gene, which modulates expression of respective host target genes thereof, the function and utility of which host target genes is known in the art.

VGAM60 is a novel bioinformatically detected regulatory, non protein coding, viral micro RNA (miRNA) gene. The method by which VGAM60 was detected is described hereinabove with reference to FIGS. 2-8.

VGAM60 gene, herein designated VGAM GENE, is a viral gene contained in the genome of Vaccinia virus. VGAM60 host target gene, herein designated VGAM HOST TARGET GENE, is a human gene contained in the human genome.

VGAM60 gene, herein designated VGAM GENE, encodes a VGAM60 precursor RNA, herein designated VGAM PRECURSOR RNA. Similar to other miRNA genes, and unlike most ordinary genes, VGAM60 precursor RNA, herein designated VGAM PRECURSOR RNA, does not encode a protein. A nucleotide sequence identical or highly similar to the nucleotide sequence of VGAM60 precursor RNA is designated SEQ ID:46, and is provided hereinbelow with reference to the sequence listing part. Nucleotide sequence SEQ ID:46 is located at position 9389 relative to the genome of Vaccinia virus.

VGAM60 precursor RNA, herein designated VGAM PRECURSOR RNA, folds onto itself, forming VGAM60 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM60 folded precursor RNA, herein designated VGAM FOLDED PRECURSOR RNA, into VGAM60 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 70%) nucleotide sequence of VGAM60 RNA is designated SEQ ID:395, and is provided hereinbelow with reference to the sequence listing part.

VGAM60 host target gene, herein designated VGAM HOST TARGET GENE, encodes a corresponding messenger RNA, VGAM60 host target RNA, herein designated VGAM HOST TARGET RNA. VGAM60 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM60 RNA, herein designated VGAM RNA, binds complementarily to one or more host target binding sites located in untranslated regions of VGAM60 host target RNA, herein designated VGAM HOST TARGET RNA. This complementary binding is due to the fact that the nucleotide sequence of VGAM60 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM60 RNA, herein designated VGAM RNA, may have a different number of host target binding sites in untranslated regions of a VGAM60 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM60 RNA, herein designated VGAM RNA, to host target binding sites on VGAM60 host target RNA, herein designated VGAM HOST TARGET RNA, such as BINDING SITE I, BINDING SITE II and BINDING SITE III, inhibits translation of VGAM60 host target RNA, herein designated VGAM HOST TARGET RNA, into VGAM60 host target protein, herein designated VGAM HOST TARGET PROTEIN. VGAM host target protein is therefore outlined by a broken line.

It is appreciated that VGAM60 host target gene, herein designated VGAM HOST TARGET GENE, in fact represents a plurality of VGAM60 host target genes. The mRNA of each one of this plurality of VGAM60 host target genes comprises one or more host target binding sites, each having a nucleotide sequence which is at least partly complementary to VGAM60 RNA, herein designated VGAM RNA, and which when bound by VGAM60 RNA, herein designated VGAM RNA, causes inhibition of translation of respective one or more VGAM60 host target proteins.

It is further appreciated by one skilled in the art that the mode of translational inhibition illustrated by FIG. 1 with specific reference to translational inhibition exerted by VGAM60 gene, herein designated VGAM GENE, on one or more VGAM60 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM60 is inhibition of expression of host target genes, as part of a novel viral mechanism of attacking a host. Accordingly, utilities of VGAM60 include diagnosis, prevention and treatment of viral infection by Vaccinia virus. Specific functions, and accordingly utilities, of VGAM60 correlate with, and may be deduced from, the identity of the host target genes which VGAM60 binds and inhibits, and the function of these host target genes, as elaborated hereinbelow.

Nucleotide sequences of the VGAM60 precursor RNA, herein designated VGAM PRECURSOR RNA, and of the diced VGAM60 RNA, herein designated VGAM RNA, and a schematic representation of the secondary folding of VGAM60 folded precursor RNA, herein designated VGAM FOLDED PRECURSOR RNA, of VGAM60 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM60 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 61 (VGAM61) viral gene, which modulates expression of respective host target genes thereof, the function and utility of which host target genes is known in the art.

VGAM61 is a novel bioinformatically detected regulatory, non protein coding, viral micro RNA (miRNA) gene. The method by which VGAM61 was detected is described hereinabove with reference to FIGS. 2-8.

VGAM61 gene, herein designated VGAM GENE, is a viral gene contained in the genome of Vaccinia virus. VGAM61 host target gene, herein designated VGAM HOST TARGET GENE, is a human gene contained in the human genome.

VGAM61 gene, herein designated VGAM GENE, encodes a VGAM61 precursor RNA, herein designated VGAM PRECURSOR RNA. Similar to other miRNA genes, and unlike most ordinary genes, VGAM61 precursor RNA, herein designated VGAM PRECURSOR RNA, does not encode a protein. A nucleotide sequence identical or highly similar to the nucleotide sequence of VGAM61 precursor RNA is designated SEQ ID:47, and is provided hereinbelow with reference to the sequence listing part. Nucleotide sequence SEQ ID:47 is located at position 8516 relative to the genome of Vaccinia virus.

VGAM61 precursor RNA, herein designated VGAM PRECURSOR RNA, folds onto itself, forming VGAM61 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM61 folded precursor RNA, herein designated VGAM FOLDED PRECURSOR RNA, into VGAM61 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM61 RNA is designated SEQ ID:396, and is provided hereinbelow with reference to the sequence listing part.

VGAM61 host target gene, herein designated VGAM HOST TARGET GENE, encodes a corresponding messenger RNA, VGAM61 host target RNA, herein designated VGAM HOST TARGET RNA. VGAM61 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM61 RNA, herein designated VGAM RNA, binds complementarily to one or more host target binding sites located in untranslated regions of VGAM61 host target RNA, herein designated VGAM HOST TARGET RNA. This complementary binding is due to the fact that the nucleotide sequence of VGAM61 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM61 RNA, herein designated VGAM RNA, may have a different number of host target binding sites in untranslated regions of a VGAM61 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM61 RNA, herein designated VGAM RNA, to host target binding sites on VGAM61 host target RNA, herein designated VGAM HOST TARGET RNA, such as BINDING SITE I, BINDING SITE II and BINDING SITE III, inhibits translation of VGAM61 host target RNA, herein designated VGAM HOST TARGET RNA, into VGAM61 host target protein, herein designated VGAM HOST TARGET PROTEIN. VGAM host target protein is therefore outlined by a broken line.

It is appreciated that VGAM61 host target gene, herein designated VGAM HOST TARGET GENE, in fact represents a plurality of VGAM61 host target genes. The mRNA of each one of this plurality of VGAM61 host target genes comprises one or more host target binding sites, each having a nucleotide sequence which is at least partly complementary to VGAM61 RNA, herein designated VGAM RNA, and which when bound by VGAM61 RNA, herein designated VGAM RNA, causes inhibition of translation of respective one or more VGAM61 host target proteins.

It is further appreciated by one skilled in the art that the mode of translational inhibition illustrated by FIG. 1 with specific reference to translational inhibition exerted by VGAM61 gene, herein designated VGAM GENE, on one or more VGAM61 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM61 is inhibition of expression of host target genes, as part of a novel viral mechanism of attacking a host. Accordingly, utilities of VGAM61 include diagnosis, prevention and treatment of viral infection by Vaccinia virus. Specific functions, and accordingly utilities, of VGAM61 correlate with, and may be deduced from, the identity of the host target genes which VGAM61 binds and inhibits, and the function of these host target genes, as elaborated hereinbelow.

Nucleotide sequences of the VGAM61 precursor RNA, herein designated VGAM PRECURSOR RNA, and of the diced VGAM61 RNA, herein designated VGAM RNA, and a schematic representation of the secondary folding of VGAM61 folded precursor RNA, herein designated VGAM FOLDED PRECURSOR RNA, of VGAM61 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM61 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 62 (VGAM62) viral gene, which modulates expression of respective host target genes thereof, the function and utility of which host target genes is known in the art.

VGAM62 is a novel bioinformatically detected regulatory, non protein coding, viral micro RNA (miRNA) gene. The method by which VGAM62 was detected is described hereinabove with reference to FIGS. 2-8.

VGAM62 gene, herein designated VGAM GENE, is a viral gene contained in the genome of Vaccinia virus. VGAM62 host target gene, herein designated VGAM HOST TARGET GENE, is a human gene contained in the human genome.

VGAM62 gene, herein designated VGAM GENE, encodes a VGAM62 precursor RNA, herein designated VGAM PRECURSOR RNA. Similar to other miRNA genes, and unlike most ordinary genes, VGAM62 precursor RNA, herein designated VGAM PRECURSOR RNA, does not encode a protein. A nucleotide sequence identical or highly similar to the nucleotide sequence of VGAM62 precursor RNA is designated SEQ ID:48, and is provided hereinbelow with reference to the sequence listing part. Nucleotide sequence SEQ ID:48 is located at position 10036 relative to the genome of Vaccinia virus.

VGAM62 precursor RNA, herein designated VGAM PRECURSOR RNA, folds onto itself, forming VGAM62 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM62 folded precursor RNA, herein designated VGAM FOLDED PRECURSOR RNA, into VGAM62 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM62 RNA is designated SEQ ID:397, and is provided hereinbelow with reference to the sequence listing part.

VGAM62 host target gene, herein designated VGAM HOST TARGET GENE, encodes a corresponding messenger RNA, VGAM62 host target RNA, herein designated VGAM HOST TARGET RNA. VGAM62 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM62 RNA, herein designated VGAM RNA, binds complementarily to one or more host target binding sites located in untranslated regions of VGAM62 host target RNA, herein designated VGAM HOST TARGET RNA. This complementary binding is due to the fact that the nucleotide sequence of VGAM62 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM62 RNA, herein designated VGAM RNA, may have a different number of host target binding sites in untranslated regions of a VGAM62 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM62 RNA, herein designated VGAM RNA, to host target binding sites on VGAM62 host target RNA, herein designated VGAM HOST TARGET RNA, such as BINDING SITE I, BINDING SITE II and BINDING SITE III, inhibits translation of VGAM62 host target RNA, herein designated VGAM HOST TARGET RNA, into VGAM62 host target protein, herein designated VGAM HOST TARGET PROTEIN. VGAM host target protein is therefore outlined by a broken line.

It is appreciated that VGAM62 host target gene, herein designated VGAM HOST TARGET GENE, in fact represents a plurality of VGAM62 host target genes. The mRNA of each one of this plurality of VGAM62 host target genes comprises one or more host target binding sites, each having a nucleotide sequence which is at least partly complementary to VGAM62 RNA, herein designated VGAM RNA, and which when bound by VGAM62 RNA, herein designated VGAM RNA, causes inhibition of translation of respective one or more VGAM62 host target proteins.

It is further appreciated by one skilled in the art that the mode of translational inhibition illustrated by FIG. 1 with specific reference to translational inhibition exerted by VGAM62 gene, herein designated VGAM GENE, on one or more VGAM62 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM62 is inhibition of expression of host target genes, as part of a novel viral mechanism of attacking a host. Accordingly, utilities of VGAM62 include diagnosis, prevention and treatment of viral infection by Vaccinia virus. Specific functions, and accordingly utilities, of VGAM62 correlate with, and may be deduced from, the identity of the host target genes which VGAM62 binds and inhibits, and the function of these host target genes, as elaborated hereinbelow.

Nucleotide sequences of the VGAM62 precursor RNA, herein designated VGAM PRECURSOR RNA, and of the diced VGAM62 RNA, herein designated VGAM RNA, and a schematic representation of the secondary folding of VGAM62 folded precursor RNA, herein designated VGAM FOLDED PRECURSOR RNA, of VGAM62 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM62 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 63 (VGAM63) viral gene, which modulates expression of respective host target genes thereof, the function and utility of which host target genes is known in the art.

VGAM63 is a novel bioinformatically detected regulatory, non protein coding, viral micro RNA (miRNA) gene. The method by which VGAM63 was detected is described hereinabove with reference to FIGS. 2-8.

VGAM63 gene, herein designated VGAM GENE, is a viral gene contained in the genome of Vaccinia virus. VGAM63 host target gene, herein designated VGAM HOST TARGET GENE, is a human gene contained in the human genome.

VGAM63 gene, herein designated VGAM GENE, encodes a VGAM63 precursor RNA, herein designated VGAM PRECURSOR RNA. Similar to other miRNA genes, and unlike most ordinary genes, VGAM63 precursor RNA, herein designated VGAM PRECURSOR RNA, does not encode a protein. A nucleotide sequence identical or highly similar to the nucleotide sequence of VGAM63 precursor RNA is designated SEQ ID:49, and is provided hereinbelow with reference to the sequence listing part. Nucleotide sequence SEQ ID:49 is located at position 14074 relative to the genome of Vaccinia virus.

VGAM63 precursor RNA, herein designated VGAM PRECURSOR RNA, folds onto itself, forming VGAM63 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM63 folded precursor RNA, herein designated VGAM FOLDED PRECURSOR RNA, into VGAM63 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 71%) nucleotide sequence of VGAM63 RNA is designated SEQ ID:398, and is provided hereinbelow with reference to the sequence listing part.

VGAM63 host target gene, herein designated VGAM HOST TARGET GENE, encodes a corresponding messenger RNA, VGAM63 host target RNA, herein designated VGAM HOST TARGET RNA. VGAM63 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM63 RNA, herein designated VGAM RNA, binds complementarily to one or more host target binding sites located in untranslated regions of VGAM63 host target RNA, herein designated VGAM HOST TARGET RNA. This complementary binding is due to the fact that the nucleotide sequence of VGAM63 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM63 RNA, herein designated VGAM RNA, may have a different number of host target binding sites in untranslated regions of a VGAM63 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM63 RNA, herein designated VGAM RNA, to host target binding sites on VGAM63 host target RNA, herein designated VGAM HOST TARGET RNA, such as BINDING SITE I, BINDING SITE II and BINDING SITE III, inhibits translation of VGAM63 host target RNA, herein designated VGAM HOST TARGET RNA, into VGAM63 host target protein, herein designated VGAM HOST TARGET PROTEIN. VGAM host target protein is therefore outlined by a broken line.

It is appreciated that VGAM63 host target gene, herein designated VGAM HOST TARGET GENE, in fact represents a plurality of VGAM63 host target genes. The mRNA of each one of this plurality of VGAM63 host target genes comprises one or more host target binding sites, each having a nucleotide sequence which is at least partly complementary to VGAM63 RNA, herein designated VGAM RNA, and which when bound by VGAM63 RNA, herein designated VGAM RNA, causes inhibition of translation of respective one or more VGAM63 host target proteins.

It is further appreciated by one skilled in the art that the mode of translational inhibition illustrated by FIG. 1 with specific reference to translational inhibition exerted by VGAM63 gene, herein designated VGAM GENE, on one or more VGAM63 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM63 is inhibition of expression of host target genes, as part of a novel viral mechanism of attacking a host. Accordingly, utilities of VGAM63 include diagnosis, prevention and treatment of viral infection by Vaccinia virus. Specific functions, and accordingly utilities, of VGAM63 correlate with, and may be deduced from, the identity of the host target genes which VGAM63 binds and inhibits, and the function of these host target genes, as elaborated hereinbelow.

Nucleotide sequences of the VGAM63 precursor RNA, herein designated VGAM PRECURSOR RNA, and of the diced VGAM63 RNA, herein designated VGAM RNA, and a schematic representation of the secondary folding of VGAM63 folded precursor RNA, herein designated VGAM FOLDED PRECURSOR RNA, of VGAM63 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM63 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 64 (VGAM64) viral gene, which modulates expression of respective host target genes thereof, the function and utility of which host target genes is known in the art.

VGAM64 is a novel bioinformatically detected regulatory, non protein coding, viral micro RNA (miRNA) gene. The method by which VGAM64 was detected is described hereinabove with reference to FIGS. 2-8.

VGAM64 gene, herein designated VGAM GENE, is a viral gene contained in the genome of Vaccinia virus. VGAM64 host target gene, herein designated VGAM HOST TARGET GENE, is a human gene contained in the human genome.

VGAM64 gene, herein designated VGAM GENE, encodes a VGAM64 precursor RNA, herein designated VGAM PRECURSOR RNA. Similar to other miRNA genes, and unlike most ordinary genes, VGAM64 precursor RNA, herein designated VGAM PRECURSOR RNA, does not encode a protein. A nucleotide sequence identical or highly similar to the nucleotide sequence of VGAM64 precursor RNA is designated SEQ ID:50, and is provided hereinbelow with reference to the sequence listing part. Nucleotide sequence SEQ ID:50 is located at position 9005 relative to the genome of Vaccinia virus.

VGAM64 precursor RNA, herein designated VGAM PRECURSOR RNA, folds onto itself, forming VGAM64 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM64 folded precursor RNA, herein designated VGAM FOLDED PRECURSOR RNA, into VGAM64 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 70%) nucleotide sequence of VGAM64 RNA is designated SEQ ID:399, and is provided hereinbelow with reference to the sequence listing part.

VGAM64 host target gene, herein designated VGAM HOST TARGET GENE, encodes a corresponding messenger RNA, VGAM64 host target RNA, herein designated VGAM HOST TARGET RNA. VGAM64 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM64 RNA, herein designated VGAM RNA, binds complementarily to one or more host target binding sites located in untranslated regions of VGAM64 host target RNA, herein designated VGAM HOST TARGET RNA. This complementary binding is due to the fact that the nucleotide sequence of VGAM64 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM64 RNA, herein designated VGAM RNA, may have a different number of host target binding sites in untranslated regions of a VGAM64 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM64 RNA, herein designated VGAM RNA, to host target binding sites on VGAM64 host target RNA, herein designated VGAM HOST TARGET RNA, such as BINDING SITE I, BINDING SITE II and BINDING SITE III, inhibits translation of VGAM64 host target RNA, herein designated VGAM HOST TARGET RNA, into VGAM64 host target protein, herein designated VGAM HOST TARGET PROTEIN. VGAM host target protein is therefore outlined by a broken line.

It is appreciated that VGAM64 host target gene, herein designated VGAM HOST TARGET GENE, in fact represents a plurality of VGAM64 host target genes. The mRNA of each one of this plurality of VGAM64 host target genes comprises one or more host target binding sites, each having a nucleotide sequence which is at least partly complementary to VGAM64 RNA, herein designated VGAM RNA, and which when bound by VGAM64 RNA, herein designated VGAM RNA, causes inhibition of translation of respective one or more VGAM64 host target proteins.

It is further appreciated by one skilled in the art that the mode of translational inhibition illustrated by FIG. 1 with specific reference to translational inhibition exerted by VGAM64 gene, herein designated VGAM GENE, on one or more VGAM64 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM64 is inhibition of expression of host target genes, as part of a novel viral mechanism of attacking a host. Accordingly, utilities of VGAM64 include diagnosis, prevention and treatment of viral infection by Vaccinia virus. Specific functions, and accordingly utilities, of VGAM64 correlate with, and may be deduced from, the identity of the host target genes which VGAM64 binds and inhibits, and the function of these host target genes, as elaborated hereinbelow.

Nucleotide sequences of the VGAM64 precursor RNA, herein designated VGAM PRECURSOR RNA, and of the diced VGAM64 RNA, herein designated VGAM RNA, and a schematic representation of the secondary folding of VGAM64 folded precursor RNA, herein designated VGAM FOLDED PRECURSOR RNA, of VGAM64 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM64 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 65 (VGAM65) viral gene, which modulates expression of respective host target genes thereof, the function and utility of which host target genes is known in the art.

VGAM65 is a novel bioinformatically detected regulatory, non protein coding, viral micro RNA (miRNA) gene. The method by which VGAM65 was detected is described hereinabove with reference to FIGS. 2-8.

VGAM65 gene, herein designated VGAM GENE, is a viral gene contained in the genome of Vaccinia virus. VGAM65 host target gene, herein designated VGAM HOST TARGET GENE, is a human gene contained in the human genome.

VGAM65 gene, herein designated VGAM GENE, encodes a VGAM65 precursor RNA, herein designated VGAM PRECURSOR RNA. Similar to other miRNA genes, and unlike most ordinary genes, VGAM65 precursor RNA, herein designated VGAM PRECURSOR RNA, does not encode a protein. A nucleotide sequence identical or highly similar to the nucleotide sequence of VGAM65 precursor RNA is designated SEQ ID:51, and is provided hereinbelow with reference to the sequence listing part. Nucleotide sequence SEQ ID:51 is located at position 10347 relative to the genome of Vaccinia virus.

VGAM65 precursor RNA, herein designated VGAM PRECURSOR RNA, folds onto itself, forming VGAM65 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM65 folded precursor RNA, herein designated VGAM FOLDED PRECURSOR RNA, into VGAM65 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 86%) nucleotide sequence of VGAM65 RNA is designated SEQ ID:400, and is provided hereinbelow with reference to the sequence listing part.

VGAM65 host target gene, herein designated VGAM HOST TARGET GENE, encodes a corresponding messenger RNA, VGAM65 host target RNA, herein designated VGAM HOST TARGET RNA. VGAM65 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM65 RNA, herein designated VGAM RNA, binds complementarily to one or more host target binding sites located in untranslated regions of VGAM65 host target RNA, herein designated VGAM HOST TARGET RNA. This complementary binding is due to the fact that the nucleotide sequence of VGAM65 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM65 RNA, herein designated VGAM RNA, may have a different number of host target binding sites in untranslated regions of a VGAM65 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM65 RNA, herein designated VGAM RNA, to host target binding sites on VGAM65 host target RNA, herein designated VGAM HOST TARGET RNA, such as BINDING SITE I, BINDING SITE II and BINDING SITE III, inhibits translation of VGAM65 host target RNA, herein designated VGAM HOST TARGET RNA, into VGAM65 host target protein, herein designated VGAM HOST TARGET PROTEIN. VGAM host target protein is therefore outlined by a broken line.

It is appreciated that VGAM65 host target gene, herein designated VGAM HOST TARGET GENE, in fact represents a plurality of VGAM65 host target genes. The mRNA of each one of this plurality of VGAM65 host target genes comprises one or more host target binding sites, each having a nucleotide sequence which is at least partly complementary to VGAM65 RNA, herein designated VGAM RNA, and which when bound by VGAM65 RNA, herein designated VGAM RNA, causes inhibition of translation of respective one or more VGAM65 host target proteins.

It is further appreciated by one skilled in the art that the mode of translational inhibition illustrated by FIG. 1 with specific reference to translational inhibition exerted by VGAM65 gene, herein designated VGAM GENE, on one or more VGAM65 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM65 is inhibition of expression of host target genes, as part of a novel viral mechanism of attacking a host. Accordingly, utilities of VGAM65 include diagnosis, prevention and treatment of viral infection by Vaccinia virus. Specific functions, and accordingly utilities, of VGAM65 correlate with, and may be deduced from, the identity of the host target genes which VGAM65 binds and inhibits, and the function of these host target genes, as elaborated hereinbelow.

Nucleotide sequences of the VGAM65 precursor RNA, herein designated VGAM PRECURSOR RNA, and of the diced VGAM65 RNA, herein designated VGAM RNA, and a schematic representation of the secondary folding of VGAM65 folded precursor RNA, herein designated VGAM FOLDED PRECURSOR RNA, of VGAM65 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM65 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 66 (VGAM66) viral gene, which modulates expression of respective host target genes thereof, the function and utility of which host target genes is known in the art.

VGAM66 is a novel bioinformatically detected regulatory, non protein coding, viral micro RNA (miRNA) gene. The method by which VGAM66 was detected is described hereinabove with reference to FIGS. 2-8.

VGAM66 gene, herein designated VGAM GENE, is a viral gene contained in the genome of Vaccinia virus. VGAM66 host target gene, herein designated VGAM HOST TARGET GENE, is a human gene contained in the human genome.

VGAM66 gene, herein designated VGAM GENE, encodes a VGAM66 precursor RNA, herein designated VGAM PRECURSOR RNA. Similar to other miRNA genes, and unlike most ordinary genes, VGAM66 precursor RNA, herein designated VGAM PRECURSOR RNA, does not encode a protein. A nucleotide sequence identical or highly similar to the nucleotide sequence of VGAM66 precursor RNA is designated SEQ ID:52, and is provided hereinbelow with reference to the sequence listing part. Nucleotide sequence SEQ ID:52 is located at position 12512 relative to the genome of Vaccinia virus.

VGAM66 precursor RNA, herein designated VGAM PRECURSOR RNA, folds onto itself, forming VGAM66 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM66 folded precursor RNA, herein designated VGAM FOLDED PRECURSOR RNA, into VGAM66 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 79%) nucleotide sequence of VGAM66 RNA is designated SEQ ID:401, and is provided hereinbelow with reference to the sequence listing part.

VGAM66 host target gene, herein designated VGAM HOST TARGET GENE, encodes a corresponding messenger RNA, VGAM66 host target RNA, herein designated VGAM HOST TARGET RNA. VGAM66 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM66 RNA, herein designated VGAM RNA, binds complementarily to one or more host target binding sites located in untranslated regions of VGAM66 host target RNA, herein designated VGAM HOST TARGET RNA. This complementary binding is due to the fact that the nucleotide sequence of VGAM66 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM66 RNA, herein designated VGAM RNA, may have a different number of host target binding sites in untranslated regions of a VGAM66 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM66 RNA, herein designated VGAM RNA, to host target binding sites on VGAM66 host target RNA, herein designated VGAM HOST TARGET RNA, such as BINDING SITE I, BINDING SITE II and BINDING SITE III, inhibits translation of VGAM66 host target RNA, herein designated VGAM HOST TARGET RNA, into VGAM66 host target protein, herein designated VGAM HOST TARGET PROTEIN. VGAM host target protein is therefore outlined by a broken line.

It is appreciated that VGAM66 host target gene, herein designated VGAM HOST TARGET GENE, in fact represents a plurality of VGAM66 host target genes. The mRNA of each one of this plurality of VGAM66 host target genes comprises one or more host target binding sites, each having a nucleotide sequence which is at least partly complementary to VGAM66 RNA, herein designated VGAM RNA, and which when bound by VGAM66 RNA, herein designated VGAM RNA, causes inhibition of translation of respective one or more VGAM66 host target proteins.

It is further appreciated by one skilled in the art that the mode of translational inhibition illustrated by FIG. 1 with specific reference to translational inhibition exerted by VGAM66 gene, herein designated VGAM GENE, on one or more VGAM66 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM66 is inhibition of expression of host target genes, as part of a novel viral mechanism of attacking a host. Accordingly, utilities of VGAM66 include diagnosis, prevention and treatment of viral infection by Vaccinia virus. Specific functions, and accordingly utilities, of VGAM66 correlate with, and may be deduced from, the identity of the host target genes which VGAM66 binds and inhibits, and the function of these host target genes, as elaborated hereinbelow.

Nucleotide sequences of the VGAM66 precursor RNA, herein designated VGAM PRECURSOR RNA, and of the diced VGAM66 RNA, herein designated VGAM RNA, and a schematic representation of the secondary folding of VGAM66 folded precursor RNA, herein designated VGAM FOLDED PRECURSOR RNA, of VGAM66 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM66 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 67 (VGAM67) viral gene, which modulates expression of respective host target genes thereof, the function and utility of which host target genes is known in the art.

VGAM67 is a novel bioinformatically detected regulatory, non protein coding, viral micro RNA (miRNA) gene. The method by which VGAM67 was detected is described hereinabove with reference to FIGS. 2-8.

VGAM67 gene, herein designated VGAM GENE, is a viral gene contained in the genome of Vaccinia virus. VGAM67 host target gene, herein designated VGAM HOST TARGET GENE, is a human gene contained in the human genome.

VGAM67 gene, herein designated VGAM GENE, encodes a VGAM67 precursor RNA, herein designated VGAM PRECURSOR RNA. Similar to other miRNA genes, and unlike most ordinary genes, VGAM67 precursor RNA, herein designated VGAM PRECURSOR RNA, does not encode a protein. A nucleotide sequence identical or highly similar to the nucleotide sequence of VGAM67 precursor RNA is designated SEQ ID:53, and is provided hereinbelow with reference to the sequence listing part. Nucleotide sequence SEQ ID:53 is located at position 12981 relative to the genome of Vaccinia virus.

VGAM67 precursor RNA, herein designated VGAM PRECURSOR RNA, folds onto itself, forming VGAM67 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM67 folded precursor RNA, herein designated VGAM FOLDED PRECURSOR RNA, into VGAM67 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM67 RNA is designated SEQ ID:402, and is provided hereinbelow with reference to the sequence listing part.

VGAM67 host target gene, herein designated VGAM HOST TARGET GENE, encodes a corresponding messenger RNA, VGAM67 host target RNA, herein designated VGAM HOST TARGET RNA. VGAM67 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM67 RNA, herein designated VGAM RNA, binds complementarily to one or more host target binding sites located in untranslated regions of VGAM67 host target RNA, herein designated VGAM HOST TARGET RNA. This complementary binding is due to the fact that the nucleotide sequence of VGAM67 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM67 RNA, herein designated VGAM RNA, may have a different number of host target binding sites in untranslated regions of a VGAM67 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM67 RNA, herein designated VGAM RNA, to host target binding sites on VGAM67 host target RNA, herein designated VGAM HOST TARGET RNA, such as BINDING SITE I, BINDING SITE II and BINDING SITE III, inhibits translation of VGAM67 host target RNA, herein designated VGAM HOST TARGET RNA, into VGAM67 host target protein, herein designated VGAM HOST TARGET PROTEIN. VGAM host target protein is therefore outlined by a broken line.

It is appreciated that VGAM67 host target gene, herein designated VGAM HOST TARGET GENE, in fact represents a plurality of VGAM67 host target genes. The mRNA of each one of this plurality of VGAM67 host target genes comprises one or more host target binding sites, each having a nucleotide sequence which is at least partly complementary to VGAM67 RNA, herein designated VGAM RNA, and which when bound by VGAM67 RNA, herein designated VGAM RNA, causes inhibition of translation of respective one or more VGAM67 host target proteins.

It is further appreciated by one skilled in the art that the mode of translational inhibition illustrated by FIG. 1 with specific reference to translational inhibition exerted by VGAM67 gene, herein designated VGAM GENE, on one or more VGAM67 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM67 is inhibition of expression of host target genes, as part of a novel viral mechanism of attacking a host. Accordingly, utilities of VGAM67 include diagnosis, prevention and treatment of viral infection by Vaccinia virus. Specific functions, and accordingly utilities, of VGAM67 correlate with, and may be deduced from, the identity of the host target genes which VGAM67 binds and inhibits, and the function of these host target genes, as elaborated hereinbelow.

Nucleotide sequences of the VGAM67 precursor RNA, herein designated VGAM PRECURSOR RNA, and of the diced VGAM67 RNA, herein designated VGAM RNA, and a schematic representation of the secondary folding of VGAM67 folded precursor RNA, herein designated VGAM FOLDED PRECURSOR RNA, of VGAM67 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM67 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 68 (VGAM68) viral gene, which modulates expression of respective host target genes thereof, the function and utility of which host target genes is known in the art.

VGAM68 is a novel bioinformatically detected regulatory, non protein coding, viral micro RNA (miRNA) gene. The method by which VGAM68 was detected is described hereinabove with reference to FIGS. 2-8.

VGAM68 gene, herein designated VGAM GENE, is a viral gene contained in the genome of Vaccinia virus. VGAM68 host target gene, herein designated VGAM HOST TARGET GENE, is a human gene contained in the human genome.

VGAM68 gene, herein designated VGAM GENE, encodes a VGAM68 precursor RNA, herein designated VGAM PRECURSOR RNA. Similar to other miRNA genes, and unlike most ordinary genes, VGAM68 precursor RNA, herein designated VGAM PRECURSOR RNA, does not encode a protein. A nucleotide sequence identical or highly similar to the nucleotide sequence of VGAM68 precursor RNA is designated SEQ ID:54, and is provided hereinbelow with reference to the sequence listing part. Nucleotide sequence SEQ ID:54 is located at position 10620 relative to the genome of Vaccinia virus.

VGAM68 precursor RNA, herein designated VGAM PRECURSOR RNA, folds onto itself, forming VGAM68 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM68 folded precursor RNA, herein designated VGAM FOLDED PRECURSOR RNA, into VGAM68 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 86%) nucleotide sequence of VGAM68 RNA is designated SEQ ID:403, and is provided hereinbelow with reference to the sequence listing part.

VGAM68 host target gene, herein designated VGAM HOST TARGET GENE, encodes a corresponding messenger RNA, VGAM68 host target RNA, herein designated VGAM HOST TARGET RNA. VGAM68 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM68 RNA, herein designated VGAM RNA, binds complementarily to one or more host target binding sites located in untranslated regions of VGAM68 host target RNA, herein designated VGAM HOST TARGET RNA. This complementary binding is due to the fact that the nucleotide sequence of VGAM68 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM68 RNA, herein designated VGAM RNA, may have a different number of host target binding sites in untranslated regions of a VGAM68 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM68 RNA, herein designated VGAM RNA, to host target binding sites on VGAM68 host target RNA, herein designated VGAM HOST TARGET RNA, such as BINDING SITE I, BINDING SITE II and BINDING SITE III, inhibits translation of VGAM68 host target RNA, herein designated VGAM HOST TARGET RNA, into VGAM68 host target protein, herein designated VGAM HOST TARGET PROTEIN. VGAM host target protein is therefore outlined by a broken line.

It is appreciated that VGAM68 host target gene, herein designated VGAM HOST TARGET GENE, in fact represents a plurality of VGAM68 host target genes. The mRNA of each one of this plurality of VGAM68 host target genes comprises one or more host target binding sites, each having a nucleotide sequence which is at least partly complementary to VGAM68 RNA, herein designated VGAM RNA, and which when bound by VGAM68 RNA, herein designated VGAM RNA, causes inhibition of translation of respective one or more VGAM68 host target proteins.

It is further appreciated by one skilled in the art that the mode of translational inhibition illustrated by FIG. 1 with specific reference to translational inhibition exerted by VGAM68 gene, herein designated VGAM GENE, on one or more VGAM68 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM68 is inhibition of expression of host target genes, as part of a novel viral mechanism of attacking a host. Accordingly, utilities of VGAM68 include diagnosis, prevention and treatment of viral infection by Vaccinia virus. Specific functions, and accordingly utilities, of VGAM68 correlate with, and may be deduced from, the identity of the host target genes which VGAM68 binds and inhibits, and the function of these host target genes, as elaborated hereinbelow.

Nucleotide sequences of the VGAM68 precursor RNA, herein designated VGAM PRECURSOR RNA, and of the diced VGAM68 RNA, herein designated VGAM RNA, and a schematic representation of the secondary folding of VGAM68 folded precursor RNA, herein designated VGAM FOLDED PRECURSOR RNA, of VGAM68 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM68 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 69 (VGAM69) viral gene, which modulates expression of respective host target genes thereof, the function and utility of which host target genes is known in the art.

VGAM69 is a novel bioinformatically detected regulatory, non protein coding, viral micro RNA (miRNA) gene. The method by which VGAM69 was detected is described hereinabove with reference to FIGS. 2-8.

VGAM69 gene, herein designated VGAM GENE, is a viral gene contained in the genome of Vaccinia virus. VGAM69 host target gene, herein designated VGAM HOST TARGET GENE, is a human gene contained in the human genome.

VGAM69 gene, herein designated VGAM GENE, encodes a VGAM69 precursor RNA, herein designated VGAM PRECURSOR RNA. Similar to other miRNA genes, and unlike most ordinary genes, VGAM69 precursor RNA, herein designated VGAM PRECURSOR RNA, does not encode a protein. A nucleotide sequence identical or highly similar to the nucleotide sequence of VGAM69 precursor RNA is designated SEQ ID: 55, and is provided hereinbelow with reference to the sequence listing part. Nucleotide sequence SEQ ID:55 is located at position 180452 relative to the genome of Vaccinia virus.

VGAM69 precursor RNA, herein designated VGAM PRECURSOR RNA, folds onto itself, forming VGAM69 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM69 folded precursor RNA, herein designated VGAM FOLDED PRECURSOR RNA, into VGAM69 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 85%) nucleotide sequence of VGAM69 RNA is designated SEQ ID:404, and is provided hereinbelow with reference to the sequence listing part.

VGAM69 host target gene, herein designated VGAM HOST TARGET GENE, encodes a corresponding messenger RNA, VGAM69 host target RNA, herein designated VGAM HOST TARGET RNA. VGAM69 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM69 RNA, herein designated VGAM RNA, binds complementarily to one or more host target binding sites located in untranslated regions of VGAM69 host target RNA, herein designated VGAM HOST TARGET RNA. This complementary binding is due to the fact that the nucleotide sequence of VGAM69 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM69 RNA, herein designated VGAM RNA, may have a different number of host target binding sites in untranslated regions of a VGAM69 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM69 RNA, herein designated VGAM RNA, to host target binding sites on VGAM69 host target RNA, herein designated VGAM HOST TARGET RNA, such as BINDING SITE I, BINDING SITE II and BINDING SITE III, inhibits translation of VGAM69 host target RNA, herein designated VGAM HOST TARGET RNA, into VGAM69 host target protein, herein designated VGAM HOST TARGET PROTEIN. VGAM host target protein is therefore outlined by a broken line.

It is appreciated that VGAM69 host target gene, herein designated VGAM HOST TARGET GENE, in fact represents a plurality of VGAM69 host target genes. The mRNA of each one of this plurality of VGAM69 host target genes comprises one or more host target binding sites, each having a nucleotide sequence which is at least partly complementary to VGAM69 RNA, herein designated VGAM RNA, and which when bound by VGAM69 RNA, herein designated VGAM RNA, causes inhibition of translation of respective one or more VGAM69 host target proteins.

It is further appreciated by one skilled in the art that the mode of translational inhibition illustrated by FIG. 1 with specific reference to translational inhibition exerted by VGAM69 gene, herein designated VGAM GENE, on one or more VGAM69 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM69 is inhibition of expression of host target genes, as part of a novel viral mechanism of attacking a host. Accordingly, utilities of VGAM69 include diagnosis, prevention and treatment of viral infection by Vaccinia virus. Specific functions, and accordingly utilities, of VGAM69 correlate with, and may be deduced from, the identity of the host target genes which VGAM69 binds and inhibits, and the function of these host target genes, as elaborated hereinbelow.

Nucleotide sequences of the VGAM69 precursor RNA, herein designated VGAM PRECURSOR RNA, and of the diced VGAM69 RNA, herein designated VGAM RNA, and a schematic representation of the secondary folding of VGAM69 folded precursor RNA, herein designated VGAM FOLDED PRECURSOR RNA, of VGAM69 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM69 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 70 (VGAM70) viral gene, which modulates expression of respective host target genes thereof, the function and utility of which host target genes is known in the art.

VGAM70 is a novel bioinformatically detected regulatory, non protein coding, viral micro RNA (miRNA) gene. The method by which VGAM70 was detected is described hereinabove with reference to FIGS. 2-8.

VGAM70 gene, herein designated VGAM GENE, is a viral gene contained in the genome of Vaccinia virus. VGAM70 host target gene, herein designated VGAM HOST TARGET GENE, is a human gene contained in the human genome.

VGAM70 gene, herein designated VGAM GENE, encodes a VGAM70 precursor RNA, herein designated VGAM PRECURSOR RNA. Similar to other miRNA genes, and unlike most ordinary genes, VGAM70 precursor RNA, herein designated VGAM PRECURSOR RNA, does not encode a protein. A nucleotide sequence identical or highly similar to the nucleotide sequence of VGAM70 precursor RNA is designated SEQ ID:56, and is provided hereinbelow with reference to the sequence listing part. Nucleotide sequence SEQ ID:56 is located at position 12513 relative to the genome of Vaccinia virus.

VGAM70 precursor RNA, herein designated VGAM PRECURSOR RNA, folds onto itself, forming VGAM70 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM70 folded precursor RNA, herein designated VGAM FOLDED PRECURSOR RNA, into VGAM70 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 77%) nucleotide sequence of VGAM70 RNA is designated SEQ ID:405, and is provided hereinbelow with reference to the sequence listing part.

VGAM70 host target gene, herein designated VGAM HOST TARGET GENE, encodes a corresponding messenger RNA, VGAM70 host target RNA, herein designated VGAM HOST TARGET RNA. VGAM70 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM70 RNA, herein designated VGAM RNA, binds complementarily to one or more host target binding sites located in untranslated regions of VGAM70 host target RNA, herein designated VGAM HOST TARGET RNA. This complementary binding is due to the fact that the nucleotide sequence of VGAM70 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM70 RNA, herein designated VGAM RNA, may have a different number of host target binding sites in untranslated regions of a VGAM70 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM70 RNA, herein designated VGAM RNA, to host target binding sites on VGAM70 host target RNA, herein designated VGAM HOST TARGET RNA, such as BINDING SITE I, BINDING SITE II and BINDING SITE III, inhibits translation of VGAM70 host target RNA, herein designated VGAM HOST TARGET RNA, into VGAM70 host target protein, herein designated VGAM HOST TARGET PROTEIN. VGAM host target protein is therefore outlined by a broken line.

It is appreciated that VGAM70 host target gene, herein designated VGAM HOST TARGET GENE, in fact represents a plurality of VGAM70 host target genes. The mRNA of each one of this plurality of VGAM70 host target genes comprises one or more host target binding sites, each having a nucleotide sequence which is at least partly complementary to VGAM70 RNA, herein designated VGAM RNA, and which when bound by VGAM70 RNA, herein designated VGAM RNA, causes inhibition of translation of respective one or more VGAM70 host target proteins.

It is further appreciated by one skilled in the art that the mode of translational inhibition illustrated by FIG. 1 with specific reference to translational inhibition exerted by VGAM70 gene, herein designated VGAM GENE, on one or more VGAM70 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM70 is inhibition of expression of host target genes, as part of a novel viral mechanism of attacking a host. Accordingly, utilities of VGAM70 include diagnosis, prevention and treatment of viral infection by Vaccinia virus. Specific functions, and accordingly utilities, of VGAM70 correlate with, and may be deduced from, the identity of the host target genes which VGAM70 binds and inhibits, and the function of these host target genes, as elaborated hereinbelow.

Nucleotide sequences of the VGAM70 precursor RNA, herein designated VGAM PRECURSOR RNA, and of the diced VGAM70 RNA, herein designated VGAM RNA, and a schematic representation of the secondary folding of VGAM70 folded precursor RNA, herein designated VGAM FOLDED PRECURSOR RNA, of VGAM70 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM70 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 71 (VGAM71) viral gene, which modulates expression of respective host target genes thereof, the function and utility of which host target genes is known in the art.

VGAM71 is a novel bioinformatically detected regulatory, non protein coding, viral micro RNA (miRNA) gene. The method by which VGAM71 was detected is described hereinabove with reference to FIGS. 2-8.

VGAM71 gene, herein designated VGAM GENE, is a viral gene contained in the genome of Vaccinia virus. VGAM71 host target gene, herein designated VGAM HOST TARGET GENE, is a human gene contained in the human genome.

VGAM71 gene, herein designated VGAM GENE, encodes a VGAM71 precursor RNA, herein designated VGAM PRECURSOR RNA. Similar to other miRNA genes, and unlike most ordinary genes, VGAM71 precursor RNA, herein designated VGAM PRECURSOR RNA, does not encode a protein. A nucleotide sequence identical or highly similar to the nucleotide sequence of VGAM71 precursor RNA is designated SEQ ID:57, and is provided hereinbelow with reference to the sequence listing part. Nucleotide sequence SEQ ID:57 is located at position 14150 relative to the genome of Vaccinia virus.

VGAM71 precursor RNA, herein designated VGAM PRECURSOR RNA, folds onto itself, forming VGAM71 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM71 folded precursor RNA, herein designated VGAM FOLDED PRECURSOR RNA, into VGAM71 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 87%) nucleotide sequence of VGAM71 RNA is designated SEQ ID:406, and is provided hereinbelow with reference to the sequence listing part.

VGAM71 host target gene, herein designated VGAM HOST TARGET GENE, encodes a corresponding messenger RNA, VGAM71 host target RNA, herein designated VGAM HOST TARGET RNA. VGAM71 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM71 RNA, herein designated VGAM RNA, binds complementarily to one or more host target binding sites located in untranslated regions of VGAM71 host target RNA, herein designated VGAM HOST TARGET RNA. This complementary binding is due to the fact that the nucleotide sequence of VGAM71 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM71 RNA, herein designated VGAM RNA, may have a different number of host target binding sites in untranslated regions of a VGAM71 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM71 RNA, herein designated VGAM RNA, to host target binding sites on VGAM71 host target RNA, herein designated VGAM HOST TARGET RNA, such as BINDING SITE I, BINDING SITE II and BINDING SITE III, inhibits translation of VGAM71 host target RNA, herein designated VGAM HOST TARGET RNA, into VGAM71 host target protein, herein designated VGAM HOST TARGET PROTEIN. VGAM host target protein is therefore outlined by a broken line.

It is appreciated that VGAM71 host target gene, herein designated VGAM HOST TARGET GENE, in fact represents a plurality of VGAM71 host target genes. The mRNA of each one of this plurality of VGAM71 host target genes comprises one or more host target binding sites, each having a nucleotide sequence which is at least partly complementary to VGAM71 RNA, herein designated VGAM RNA, and which when bound by VGAM71 RNA, herein designated VGAM RNA, causes inhibition of translation of respective one or more VGAM71 host target proteins.

It is further appreciated by one skilled in the art that the mode of translational inhibition illustrated by FIG. 1 with specific reference to translational inhibition exerted by VGAM71 gene, herein designated VGAM GENE, on one or more VGAM71 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM71 is inhibition of expression of host target genes, as part of a novel viral mechanism of attacking a host. Accordingly, utilities of VGAM71 include diagnosis, prevention and treatment of viral infection by Vaccinia virus. Specific functions, and accordingly utilities, of VGAM71 correlate with, and may be deduced from, the identity of the host target genes which VGAM71 binds and inhibits, and the function of these host target genes, as elaborated hereinbelow.

Nucleotide sequences of the VGAM71 precursor RNA, herein designated VGAM PRECURSOR RNA, and of the diced VGAM71 RNA, herein designated VGAM RNA, and a schematic representation of the secondary folding of VGAM71 folded precursor RNA, herein designated VGAM FOLDED PRECURSOR RNA, of VGAM71 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM71 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 72 (VGAM72) viral gene, which modulates expression of respective host target genes thereof, the function and utility of which host target genes is known in the art.

VGAM72 is a novel bioinformatically detected regulatory, non protein coding, viral micro RNA (miRNA) gene. The method by which VGAM72 was detected is described hereinabove with reference to FIGS. 2-8.

VGAM72 gene, herein designated VGAM GENE, is a viral gene contained in the genome of Vaccinia virus. VGAM72 host target gene, herein designated VGAM HOST TARGET GENE, is a human gene contained in the human genome.

VGAM72 gene, herein designated VGAM GENE, encodes a VGAM72 precursor RNA, herein designated VGAM PRECURSOR RNA. Similar to other miRNA genes, and unlike most ordinary genes, VGAM72 precursor RNA, herein designated VGAM PRECURSOR RNA, does not encode a protein. A nucleotide sequence identical or highly similar to the nucleotide sequence of VGAM72 precursor RNA is designated SEQ ID:58, and is provided hereinbelow with reference to the sequence listing part. Nucleotide sequence SEQ ID:58 is located at position 14074 relative to the genome of Vaccinia virus.

VGAM72 precursor RNA, herein designated VGAM PRECURSOR RNA, folds onto itself, forming VGAM72 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM72 folded precursor RNA, herein designated VGAM FOLDED PRECURSOR RNA, into VGAM72 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 70%) nucleotide sequence of VGAM72 RNA is designated SEQ ID:407, and is provided hereinbelow with reference to the sequence listing part.

VGAM72 host target gene, herein designated VGAM HOST TARGET GENE, encodes a corresponding messenger RNA, VGAM72 host target RNA, herein designated VGAM HOST TARGET RNA. VGAM72 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM72 RNA, herein designated VGAM RNA, binds complementarily to one or more host target binding sites located in untranslated regions of VGAM72 host target RNA, herein designated VGAM HOST TARGET RNA. This complementary binding is due to the fact that the nucleotide sequence of VGAM72 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM72 RNA, herein designated VGAM RNA, may have a different number of host target binding sites in untranslated regions of a VGAM72 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM72 RNA, herein designated VGAM RNA, to host target binding sites on VGAM72 host target RNA, herein designated VGAM HOST TARGET RNA, such as BINDING SITE I, BINDING SITE II and BINDING SITE III, inhibits translation of VGAM72 host target RNA, herein designated VGAM HOST TARGET RNA, into VGAM72 host target protein, herein designated VGAM HOST TARGET PROTEIN. VGAM host target protein is therefore outlined by a broken line.

It is appreciated that VGAM72 host target gene, herein designated VGAM HOST TARGET GENE, in fact represents a plurality of VGAM72 host target genes. The mRNA of each one of this plurality of VGAM72 host target genes comprises one or more host target binding sites, each having a nucleotide sequence which is at least partly complementary to VGAM72 RNA, herein designated VGAM RNA, and which when bound by VGAM72 RNA, herein designated VGAM RNA, causes inhibition of translation of respective one or more VGAM72 host target proteins.

It is further appreciated by one skilled in the art that the mode of translational inhibition illustrated by FIG. 1 with specific reference to translational inhibition exerted by VGAM72 gene, herein designated VGAM GENE, on one or more VGAM72 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM72 is inhibition of expression of host target genes, as part of a novel viral mechanism of attacking a host. Accordingly, utilities of VGAM72 include diagnosis, prevention and treatment of viral infection by Vaccinia virus. Specific functions, and accordingly utilities, of VGAM72 correlate with, and may be deduced from, the identity of the host target genes which VGAM72 binds and inhibits, and the function of these host target genes, as elaborated hereinbelow.

Nucleotide sequences of the VGAM72 precursor RNA, herein designated VGAM PRECURSOR RNA, and of the diced VGAM72 RNA, herein designated VGAM RNA, and a schematic representation of the secondary folding of VGAM72 folded precursor RNA, herein designated VGAM FOLDED PRECURSOR RNA, of VGAM72 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM72 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 73 (VGAM73) viral gene, which modulates expression of respective host target genes thereof, the function and utility of which host target genes is known in the art.

VGAM73 is a novel bioinformatically detected regulatory, non protein coding, viral micro RNA (miRNA) gene. The method by which VGAM73 was detected is described hereinabove with reference to FIGS. 2-8.

VGAM73 gene, herein designated VGAM GENE, is a viral gene contained in the genome of Vaccinia virus. VGAM73 host target gene, herein designated VGAM HOST TARGET GENE, is a human gene contained in the human genome.

VGAM73 gene, herein designated VGAM GENE, encodes a VGAM73 precursor RNA, herein designated VGAM PRECURSOR RNA. Similar to other miRNA genes, and unlike most ordinary genes, VGAM73 precursor RNA, herein designated VGAM PRECURSOR RNA, does not encode a protein. A nucleotide sequence identical or highly similar to the nucleotide sequence of VGAM73 precursor RNA is designated SEQ ID:59, and is provided hereinbelow with reference to the sequence listing part. Nucleotide sequence SEQ ID:59 is located at position 14338 relative to the genome of Vaccinia virus.

VGAM73 precursor RNA, herein designated VGAM PRECURSOR RNA, folds onto itself, forming VGAM73 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM73 folded precursor RNA, herein designated VGAM FOLDED PRECURSOR RNA, into VGAM73 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM73 RNA is designated SEQ ID:408, and is provided hereinbelow with reference to the sequence listing part.

VGAM73 host target gene, herein designated VGAM HOST TARGET GENE, encodes a corresponding messenger RNA, VGAM73 host target RNA, herein designated VGAM HOST TARGET RNA. VGAM73 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM73 RNA, herein designated VGAM RNA, binds complementarily to one or more host target binding sites located in untranslated regions of VGAM73 host target RNA, herein designated VGAM HOST TARGET RNA. This complementary binding is due to the fact that the nucleotide sequence of VGAM73 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM73 RNA, herein designated VGAM RNA, may have a different number of host target binding sites in untranslated regions of a VGAM73 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM73 RNA, herein designated VGAM RNA, to host target binding sites on VGAM73 host target RNA, herein designated VGAM HOST TARGET RNA, such as BINDING SITE I, BINDING SITE II and BINDING SITE III, inhibits translation of VGAM73 host target RNA, herein designated VGAM HOST TARGET RNA, into VGAM73 host target protein, herein designated VGAM HOST TARGET PROTEIN. VGAM host target protein is therefore outlined by a broken line.

It is appreciated that VGAM73 host target gene, herein designated VGAM HOST TARGET GENE, in fact represents a plurality of VGAM73 host target genes. The mRNA of each one of this plurality of VGAM73 host target genes comprises one or more host target binding sites, each having a nucleotide sequence which is at least partly complementary to VGAM73 RNA, herein designated VGAM RNA, and which when bound by VGAM73 RNA, herein designated VGAM RNA, causes inhibition of translation of respective one or more VGAM73 host target proteins.

It is further appreciated by one skilled in the art that the mode of translational inhibition illustrated by FIG. 1 with specific reference to translational inhibition exerted by VGAM73 gene, herein designated VGAM GENE, on one or more VGAM73 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM73 is inhibition of expression of host target genes, as part of a novel viral mechanism of attacking a host. Accordingly, utilities of VGAM73 include diagnosis, prevention and treatment of viral infection by Vaccinia virus. Specific functions, and accordingly utilities, of VGAM73 correlate with, and may be deduced from, the identity of the host target genes which VGAM73 binds and inhibits, and the function of these host target genes, as elaborated hereinbelow.

Nucleotide sequences of the VGAM73 precursor RNA, herein designated VGAM PRECURSOR RNA, and of the diced VGAM73 RNA, herein designated VGAM RNA, and a schematic representation of the secondary folding of VGAM73 folded precursor RNA, herein designated VGAM FOLDED PRECURSOR RNA, of VGAM73 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM73 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 74 (VGAM74) viral gene, which modulates expression of respective host target genes thereof, the function and utility of which host target genes is known in the art.

VGAM74 is a novel bioinformatically detected regulatory, non protein coding, viral micro RNA (miRNA) gene. The method by which VGAM74 was detected is described hereinabove with reference to FIGS. 2-8.

VGAM74 gene, herein designated VGAM GENE, is a viral gene contained in the genome of Vaccinia virus. VGAM74 host target gene, herein designated VGAM HOST TARGET GENE, is a human gene contained in the human genome.

VGAM74 gene, herein designated VGAM GENE, encodes a VGAM74 precursor RNA, herein designated VGAM PRECURSOR RNA. Similar to other miRNA genes, and unlike most ordinary genes, VGAM74 precursor RNA, herein designated VGAM PRECURSOR RNA, does not encode a protein. A nucleotide sequence identical or highly similar to the nucleotide sequence of VGAM74 precursor RNA is designated SEQ ID:60, and is provided hereinbelow with reference to the sequence listing part. Nucleotide sequence SEQ ID:60 is located at position 15206 relative to the genome of Vaccinia virus.

VGAM74 precursor RNA, herein designated VGAM PRECURSOR RNA, folds onto itself, forming VGAM74 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM74 folded precursor RNA, herein designated VGAM FOLDED PRECURSOR RNA, into VGAM74 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 87%) nucleotide sequence of VGAM74 RNA is designated SEQ ID:409, and is provided hereinbelow with reference to the sequence listing part.

VGAM74 host target gene, herein designated VGAM HOST TARGET GENE, encodes a corresponding messenger RNA, VGAM74 host target RNA, herein designated VGAM HOST TARGET RNA. VGAM74 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM74 RNA, herein designated VGAM RNA, binds complementarily to one or more host target binding sites located in untranslated regions of VGAM74 host target RNA, herein designated VGAM HOST TARGET RNA. This complementary binding is due to the fact that the nucleotide sequence of VGAM74 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM74 RNA, herein designated VGAM RNA, may have a different number of host target binding sites in untranslated regions of a VGAM74 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM74 RNA, herein designated VGAM RNA, to host target binding sites on VGAM74 host target RNA, herein designated VGAM HOST TARGET RNA, such as BINDING SITE I, BINDING SITE II and BINDING SITE III, inhibits translation of VGAM74 host target RNA, herein designated VGAM HOST TARGET RNA, into VGAM74 host target protein, herein designated VGAM HOST TARGET PROTEIN. VGAM host target protein is therefore outlined by a broken line.

It is appreciated that VGAM74 host target gene, herein designated VGAM HOST TARGET GENE, in fact represents a plurality of VGAM74 host target genes. The mRNA of each one of this plurality of VGAM74 host target genes comprises one or more host target binding sites, each having a nucleotide sequence which is at least partly complementary to VGAM74 RNA, herein designated VGAM RNA, and which when bound by VGAM74 RNA, herein designated VGAM RNA, causes inhibition of translation of respective one or more VGAM74 host target proteins.

It is further appreciated by one skilled in the art that the mode of translational inhibition illustrated by FIG. 1 with specific reference to translational inhibition exerted by VGAM74 gene, herein designated VGAM GENE, on one or more VGAM74 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM74 is inhibition of expression of host target genes, as part of a novel viral mechanism of attacking a host. Accordingly, utilities of VGAM74 include diagnosis, prevention and treatment of viral infection by Vaccinia virus. Specific functions, and accordingly utilities, of VGAM74 correlate with, and may be deduced from, the identity of the host target genes which VGAM74 binds and inhibits, and the function of these host target genes, as elaborated hereinbelow.

Nucleotide sequences of the VGAM74 precursor RNA, herein designated VGAM PRECURSOR RNA, and of the diced VGAM74 RNA, herein designated VGAM RNA, and a schematic representation of the secondary folding of VGAM74 folded precursor RNA, herein designated VGAM FOLDED PRECURSOR RNA, of VGAM74 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM74 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 75 (VGAM75) viral gene, which modulates expression of respective host target genes thereof, the function and utility of which host target genes is known in the art.

VGAM75 is a novel bioinformatically detected regulatory, non protein coding, viral micro RNA (miRNA) gene. The method by which VGAM75 was detected is described hereinabove with reference to FIGS. 2-8.

VGAM75 gene, herein designated VGAM GENE, is a viral gene contained in the genome of Vaccinia virus. VGAM75 host target gene, herein designated VGAM HOST TARGET GENE, is a human gene contained in the human genome.

VGAM75 gene, herein designated VGAM GENE, encodes a VGAM75 precursor RNA, herein designated VGAM PRECURSOR RNA. Similar to other miRNA genes, and unlike most ordinary genes, VGAM75 precursor RNA, herein designated VGAM PRECURSOR RNA, does not encode a protein. A nucleotide sequence identical or highly similar to the nucleotide sequence of VGAM75 precursor RNA is designated SEQ ID:61, and is provided hereinbelow with reference to the sequence listing part. Nucleotide sequence SEQ ID:61 is located at position 14680 relative to the genome of Vaccinia virus.

VGAM75 precursor RNA, herein designated VGAM PRECURSOR RNA, folds onto itself, forming VGAM75 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM75 folded precursor RNA, herein designated VGAM FOLDED PRECURSOR RNA, into VGAM75 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 89%) nucleotide sequence of VGAM75 RNA is designated SEQ ID:410, and is provided hereinbelow with reference to the sequence listing part.

VGAM75 host target gene, herein designated VGAM HOST TARGET GENE, encodes a corresponding messenger RNA, VGAM75 host target RNA, herein designated VGAM HOST TARGET RNA. VGAM75 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM75 RNA, herein designated VGAM RNA, binds complementarily to one or more host target binding sites located in untranslated regions of VGAM75 host target RNA, herein designated VGAM HOST TARGET RNA. This complementary binding is due to the fact that the nucleotide sequence of VGAM75 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM75 RNA, herein designated VGAM RNA, may have a different number of host target binding sites in untranslated regions of a VGAM75 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM75 RNA, herein designated VGAM RNA, to host target binding sites on VGAM75 host target RNA, herein designated VGAM HOST TARGET RNA, such as BINDING SITE I, BINDING SITE II and BINDING SITE III, inhibits translation of VGAM75 host target RNA, herein designated VGAM HOST TARGET RNA, into VGAM75 host target protein, herein designated VGAM HOST TARGET PROTEIN. VGAM host target protein is therefore outlined by a broken line.

It is appreciated that VGAM75 host target gene, herein designated VGAM HOST TARGET GENE, in fact represents a plurality of VGAM75 host target genes. The mRNA of each one of this plurality of VGAM75 host target genes comprises one or more host target binding sites, each having a nucleotide sequence which is at least partly complementary to VGAM75 RNA, herein designated VGAM RNA, and which when bound by VGAM75 RNA, herein designated VGAM RNA, causes inhibition of translation of respective one or more VGAM75 host target proteins.

It is further appreciated by one skilled in the art that the mode of translational inhibition illustrated by FIG. 1 with specific reference to translational inhibition exerted by VGAM75 gene, herein designated VGAM GENE, on one or more VGAM75 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM75 is inhibition of expression of host target genes, as part of a novel viral mechanism of attacking a host. Accordingly, utilities of VGAM75 include diagnosis, prevention and treatment of viral infection by Vaccinia virus. Specific functions, and accordingly utilities, of VGAM75 correlate with, and may be deduced from, the identity of the host target genes which VGAM75 binds and inhibits, and the function of these host target genes, as elaborated hereinbelow.

Nucleotide sequences of the VGAM75 precursor RNA, herein designated VGAM PRECURSOR RNA, and of the diced VGAM75 RNA, herein designated VGAM RNA, and a schematic representation of the secondary folding of VGAM75 folded precursor RNA, herein designated VGAM FOLDED PRECURSOR RNA, of VGAM75 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM75 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 76 (VGAM76) viral gene, which modulates expression of respective host target genes thereof, the function and utility of which host target genes is known in the art.

VGAM76 is a novel bioinformatically detected regulatory, non protein coding, viral micro RNA (miRNA) gene. The method by which VGAM76 was detected is described hereinabove with reference to FIGS. 2-8.

VGAM76 gene, herein designated VGAM GENE, is a viral gene contained in the genome of Vaccinia virus. VGAM76 host target gene, herein designated VGAM HOST TARGET GENE, is a human gene contained in the human genome.

VGAM76 gene, herein designated VGAM GENE, encodes a VGAM76 precursor RNA, herein designated VGAM PRECURSOR RNA. Similar to other miRNA genes, and unlike most ordinary genes, VGAM76 precursor RNA, herein designated VGAM PRECURSOR RNA, does not encode a protein. A nucleotide sequence identical or highly similar to the nucleotide sequence of VGAM76 precursor RNA is designated SEQ ID:62, and is provided hereinbelow with reference to the sequence listing part. Nucleotide sequence SEQ ID:62 is located at position 15884 relative to the genome of Vaccinia virus.

VGAM76 precursor RNA, herein designated VGAM PRECURSOR RNA, folds onto itself, forming VGAM76 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM76 folded precursor RNA, herein designated VGAM FOLDED PRECURSOR RNA, into VGAM76 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM76 RNA is designated SEQ ID:411, and is provided hereinbelow with reference to the sequence listing part.

VGAM76 host target gene, herein designated VGAM HOST TARGET GENE, encodes a corresponding messenger RNA, VGAM76 host target RNA, herein designated VGAM HOST TARGET RNA. VGAM76 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM76 RNA, herein designated VGAM RNA, binds complementarily to one or more host target binding sites located in untranslated regions of VGAM76 host target RNA, herein designated VGAM HOST TARGET RNA. This complementary binding is due to the fact that the nucleotide sequence of VGAM76 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM76 RNA, herein designated VGAM RNA, may have a different number of host target binding sites in untranslated regions of a VGAM76 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM76 RNA, herein designated VGAM RNA, to host target binding sites on VGAM76 host target RNA, herein designated VGAM HOST TARGET RNA, such as BINDING SITE I, BINDING SITE II and BINDING SITE III, inhibits translation of VGAM76 host target RNA, herein designated VGAM HOST TARGET RNA, into VGAM76 host target protein, herein designated VGAM HOST TARGET PROTEIN. VGAM host target protein is therefore outlined by a broken line.

It is appreciated that VGAM76 host target gene, herein designated VGAM HOST TARGET GENE, in fact represents a plurality of VGAM76 host target genes. The mRNA of each one of this plurality of VGAM76 host target genes comprises one or more host target binding sites, each having a nucleotide sequence which is at least partly complementary to VGAM76 RNA, herein designated VGAM RNA, and which when bound by VGAM76 RNA, herein designated VGAM RNA, causes inhibition of translation of respective one or more VGAM76 host target proteins.

It is further appreciated by one skilled in the art that the mode of translational inhibition illustrated by FIG. 1 with specific reference to translational inhibition exerted by VGAM76 gene, herein designated VGAM GENE, on one or more VGAM76 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM76 is inhibition of expression of host target genes, as part of a novel viral mechanism of attacking a host. Accordingly, utilities of VGAM76 include diagnosis, prevention and treatment of viral infection by Vaccinia virus. Specific functions, and accordingly utilities, of VGAM76 correlate with, and may be deduced from, the identity of the host target genes which VGAM76 binds and inhibits, and the function of these host target genes, as elaborated hereinbelow.

Nucleotide sequences of the VGAM76 precursor RNA, herein designated VGAM PRECURSOR RNA, and of the diced VGAM76 RNA, herein designated VGAM RNA, and a schematic representation of the secondary folding of VGAM76 folded precursor RNA, herein designated VGAM FOLDED PRECURSOR RNA, of VGAM76 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM76 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 77 (VGAM77) viral gene, which modulates expression of respective host target genes thereof, the function and utility of which host target genes is known in the art.

VGAM77 is a novel bioinformatically detected regulatory, non protein coding, viral micro RNA (miRNA) gene. The method by which VGAM77 was detected is described hereinabove with reference to FIGS. 2-8.

VGAM77 gene, herein designated VGAM GENE, is a viral gene contained in the genome of Vaccinia virus. VGAM77 host target gene, herein designated VGAM HOST TARGET GENE, is a human gene contained in the human genome.

VGAM77 gene, herein designated VGAM GENE, encodes a VGAM77 precursor RNA, herein designated VGAM PRECURSOR RNA. Similar to other miRNA genes, and unlike most ordinary genes, VGAM77 precursor RNA, herein designated VGAM PRECURSOR RNA, does not encode a protein. A nucleotide sequence identical or highly similar to the nucleotide sequence of VGAM77 precursor RNA is designated SEQ ID:63, and is provided hereinbelow with reference to the sequence listing part. Nucleotide sequence SEQ ID:63 is located at position 17339 relative to the genome of Vaccinia virus.

VGAM77 precursor RNA, herein designated VGAM PRECURSOR RNA, folds onto itself, forming VGAM77 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM77 folded precursor RNA, herein designated VGAM FOLDED PRECURSOR RNA, into VGAM77 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 77%) nucleotide sequence of VGAM77 RNA is designated SEQ ID:412, and is provided hereinbelow with reference to the sequence listing part.

VGAM77 host target gene, herein designated VGAM HOST TARGET GENE, encodes a corresponding messenger RNA, VGAM77 host target RNA, herein designated VGAM HOST TARGET RNA. VGAM77 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM77 RNA, herein designated VGAM RNA, binds complementarily to one or more host target binding sites located in untranslated regions of VGAM77 host target RNA, herein designated VGAM HOST TARGET RNA. This complementary binding is due to the fact that the nucleotide sequence of VGAM77 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM77 RNA, herein designated VGAM RNA, may have a different number of host target binding sites in untranslated regions of a VGAM77 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM77 RNA, herein designated VGAM RNA, to host target binding sites on VGAM77 host target RNA, herein designated VGAM HOST TARGET RNA, such as BINDING SITE I, BINDING SITE II and BINDING SITE III, inhibits translation of VGAM77 host target RNA, herein designated VGAM HOST TARGET RNA, into VGAM77 host target protein, herein designated VGAM HOST TARGET PROTEIN. VGAM host target protein is therefore outlined by a broken line.

It is appreciated that VGAM77 host target gene, herein designated VGAM HOST TARGET GENE, in fact represents a plurality of VGAM77 host target genes. The mRNA of each one of this plurality of VGAM77 host target genes comprises one or more host target binding sites, each having a nucleotide sequence which is at least partly complementary to VGAM77 RNA, herein designated VGAM RNA, and which when bound by VGAM77 RNA, herein designated VGAM RNA, causes inhibition of translation of respective one or more VGAM77 host target proteins.

It is further appreciated by one skilled in the art that the mode of translational inhibition illustrated by FIG. 1 with specific reference to translational inhibition exerted by VGAM77 gene, herein designated VGAM GENE, on one or more VGAM77 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM77 is inhibition of expression of host target genes, as part of a novel viral mechanism of attacking a host. Accordingly, utilities of VGAM77 include diagnosis, prevention and treatment of viral infection by Vaccinia virus. Specific functions, and accordingly utilities, of VGAM77 correlate with, and may be deduced from, the identity of the host target genes which VGAM77 binds and inhibits, and the function of these host target genes, as elaborated hereinbelow.

Nucleotide sequences of the VGAM77 precursor RNA, herein designated VGAM PRECURSOR RNA, and of the diced VGAM77 RNA, herein designated VGAM RNA, and a schematic representation of the secondary folding of VGAM77 folded precursor RNA, herein designated VGAM FOLDED PRECURSOR RNA, of VGAM77 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM77 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 78 (VGAM78) viral gene, which modulates expression of respective host target genes thereof, the function and utility of which host target genes is known in the art.

VGAM78 is a novel bioinformatically detected regulatory, non protein coding, viral micro RNA (miRNA) gene. The method by which VGAM78 was detected is described hereinabove with reference to FIGS. 2-8.

VGAM78 gene, herein designated VGAM GENE, is a viral gene contained in the genome of Vaccinia virus. VGAM78 host target gene, herein designated VGAM HOST TARGET GENE, is a human gene contained in the human genome.

VGAM78 gene, herein designated VGAM GENE, encodes a VGAM78 precursor RNA, herein designated VGAM PRECURSOR RNA. Similar to other miRNA genes, and unlike most ordinary genes, VGAM78 precursor RNA, herein designated VGAM PRECURSOR RNA, does not encode a protein. A nucleotide sequence identical or highly similar to the nucleotide sequence of VGAM78 precursor RNA is designated SEQ ID:64, and is provided hereinbelow with reference to the sequence listing part. Nucleotide sequence SEQ ID:64 is located at position 17430 relative to the genome of Vaccinia virus.

VGAM78 precursor RNA, herein designated VGAM PRECURSOR RNA, folds onto itself, forming VGAM78 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM78 folded precursor RNA, herein designated VGAM FOLDED PRECURSOR RNA, into VGAM78 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 88%) nucleotide sequence of VGAM78 RNA is designated SEQ ID:413, and is provided hereinbelow with reference to the sequence listing part.

VGAM78 host target gene, herein designated VGAM HOST TARGET GENE, encodes a corresponding messenger RNA, VGAM78 host target RNA, herein designated VGAM HOST TARGET RNA. VGAM78 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM78 RNA, herein designated VGAM RNA, binds complementarily to one or more host target binding sites located in untranslated regions of VGAM78 host target RNA, herein designated VGAM HOST TARGET RNA. This complementary binding is due to the fact that the nucleotide sequence of VGAM78 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM78 RNA, herein designated VGAM RNA, may have a different number of host target binding sites in untranslated regions of a VGAM78 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM78 RNA, herein designated VGAM RNA, to host target binding sites on VGAM78 host target RNA, herein designated VGAM HOST TARGET RNA, such as BINDING SITE I, BINDING SITE II and BINDING SITE III, inhibits translation of VGAM78 host target RNA, herein designated VGAM HOST TARGET RNA, into VGAM78 host target protein, herein designated VGAM HOST TARGET PROTEIN. VGAM host target protein is therefore outlined by a broken line.

It is appreciated that VGAM78 host target gene, herein designated VGAM HOST TARGET GENE, in fact represents a plurality of VGAM78 host target genes. The mRNA of each one of this plurality of VGAM78 host target genes comprises one or more host target binding sites, each having a nucleotide sequence which is at least partly complementary to VGAM78 RNA, herein designated VGAM RNA, and which when bound by VGAM78 RNA, herein designated VGAM RNA, causes inhibition of translation of respective one or more VGAM78 host target proteins.

It is further appreciated by one skilled in the art that the mode of translational inhibition illustrated by FIG. 1 with specific reference to translational inhibition exerted by VGAM78 gene, herein designated VGAM GENE, on one or more VGAM78 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM78 is inhibition of expression of host target genes, as part of a novel viral mechanism of attacking a host. Accordingly, utilities of VGAM78 include diagnosis, prevention and treatment of viral infection by Vaccinia virus. Specific functions, and accordingly utilities, of VGAM78 correlate with, and may be deduced from, the identity of the host target genes which VGAM78 binds and inhibits, and the function of these host target genes, as elaborated hereinbelow.

Nucleotide sequences of the VGAM78 precursor RNA, herein designated VGAM PRECURSOR RNA, and of the diced VGAM78 RNA, herein designated VGAM RNA, and a schematic representation of the secondary folding of VGAM78 folded precursor RNA, herein designated VGAM FOLDED PRECURSOR RNA, of VGAM78 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM78 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 79 (VGAM79) viral gene, which modulates expression of respective host target genes thereof, the function and utility of which host target genes is known in the art.

VGAM79 is a novel bioinformatically detected regulatory, non protein coding, viral micro RNA (miRNA) gene. The method by which VGAM79 was detected is described hereinabove with reference to FIGS. 2-8.

VGAM79 gene, herein designated VGAM GENE, is a viral gene contained in the genome of Vaccinia virus. VGAM79 host target gene, herein designated VGAM HOST TARGET GENE, is a human gene contained in the human genome.

VGAM79 gene, herein designated VGAM GENE, encodes a VGAM79 precursor RNA, herein designated VGAM PRECURSOR RNA. Similar to other miRNA genes, and unlike most ordinary genes, VGAM79 precursor RNA, herein designated VGAM PRECURSOR RNA, does not encode a protein. A nucleotide sequence identical or highly similar to the nucleotide sequence of VGAM79 precursor RNA is designated SEQ ID:65, and is provided hereinbelow with reference to the sequence listing part. Nucleotide sequence SEQ ID:65 is located at position 17229 relative to the genome of Vaccinia virus.

VGAM79 precursor RNA, herein designated VGAM PRECURSOR RNA, folds onto itself, forming VGAM79 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM79 folded precursor RNA, herein designated VGAM FOLDED PRECURSOR RNA, into VGAM79 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 89%) nucleotide sequence of VGAM79 RNA is designated SEQ ID:414, and is provided hereinbelow with reference to the sequence listing part.

VGAM79 host target gene, herein designated VGAM HOST TARGET GENE, encodes a corresponding messenger RNA, VGAM79 host target RNA, herein designated VGAM HOST TARGET RNA. VGAM79 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM79 RNA, herein designated VGAM RNA, binds complementarily to one or more host target binding sites located in untranslated regions of VGAM79 host target RNA, herein designated VGAM HOST TARGET RNA. This complementary binding is due to the fact that the nucleotide sequence of VGAM79 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM79 RNA, herein designated VGAM RNA, may have a different number of host target binding sites in untranslated regions of a VGAM79 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM79 RNA, herein designated VGAM RNA, to host target binding sites on VGAM79 host target RNA, herein designated VGAM HOST TARGET RNA, such as BINDING SITE I, BINDING SITE II and BINDING SITE III, inhibits translation of VGAM79 host target RNA, herein designated VGAM HOST TARGET RNA, into VGAM79 host target protein, herein designated VGAM HOST TARGET PROTEIN. VGAM host target protein is therefore outlined by a broken line.

It is appreciated that VGAM79 host target gene, herein designated VGAM HOST TARGET GENE, in fact represents a plurality of VGAM79 host target genes. The mRNA of each one of this plurality of VGAM79 host target genes comprises one or more host target binding sites, each having a nucleotide sequence which is at least partly complementary to VGAM79 RNA, herein designated VGAM RNA, and which when bound by VGAM79 RNA, herein designated VGAM RNA, causes inhibition of translation of respective one or more VGAM79 host target proteins.

It is further appreciated by one skilled in the art that the mode of translational inhibition illustrated by FIG. 1 with specific reference to translational inhibition exerted by VGAM79 gene, herein designated VGAM GENE, on one or more VGAM79 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM79 is inhibition of expression of host target genes, as part of a novel viral mechanism of attacking a host. Accordingly, utilities of VGAM79 include diagnosis, prevention and treatment of viral infection by Vaccinia virus. Specific functions, and accordingly utilities, of VGAM79 correlate with, and may be deduced from, the identity of the host target genes which VGAM79 binds and inhibits, and the function of these host target genes, as elaborated hereinbelow.

Nucleotide sequences of the VGAM79 precursor RNA, herein designated VGAM PRECURSOR RNA, and of the diced VGAM79 RNA, herein designated VGAM RNA, and a schematic representation of the secondary folding of VGAM79 folded precursor RNA, herein designated VGAM FOLDED PRECURSOR RNA, of VGAM79 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM79 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 80 (VGAM80) viral gene, which modulates expression of respective host target genes thereof, the function and utility of which host target genes is known in the art.

VGAM80 is a novel bioinformatically detected regulatory, non protein coding, viral micro RNA (miRNA) gene. The method by which VGAM80 was detected is described hereinabove with reference to FIGS. 2-8.

VGAM80 gene, herein designated VGAM GENE, is a viral gene contained in the genome of Vaccinia virus. VGAM80 host target gene, herein designated VGAM HOST TARGET GENE, is a human gene contained in the human genome.

VGAM80 gene, herein designated VGAM GENE, encodes a VGAM80 precursor RNA, herein designated VGAM PRECURSOR RNA. Similar to other miRNA genes, and unlike most ordinary genes, VGAM80 precursor RNA, herein designated VGAM PRECURSOR RNA, does not encode a protein. A nucleotide sequence identical or highly similar to the nucleotide sequence of VGAM80 precursor RNA is designated SEQ ID:66, and is provided hereinbelow with reference to the sequence listing part. Nucleotide sequence SEQ ID:66 is located at position 18904 relative to the genome of Vaccinia virus.

VGAM80 precursor RNA, herein designated VGAM PRECURSOR RNA, folds onto itself, forming VGAM80 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM80 folded precursor RNA, herein designated VGAM FOLDED PRECURSOR RNA, into VGAM80 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 70%) nucleotide sequence of VGAM80 RNA is designated SEQ ID:415, and is provided hereinbelow with reference to the sequence listing part.

VGAM80 host target gene, herein designated VGAM HOST TARGET GENE, encodes a corresponding messenger RNA, VGAM80 host target RNA, herein designated VGAM HOST TARGET RNA. VGAM80 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM80 RNA, herein designated VGAM RNA, binds complementarily to one or more host target binding sites located in untranslated regions of VGAM80 host target RNA, herein designated VGAM HOST TARGET RNA. This complementary binding is due to the fact that the nucleotide sequence of VGAM80 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM80 RNA, herein designated VGAM RNA, may have a different number of host target binding sites in untranslated regions of a VGAM80 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM80 RNA, herein designated VGAM RNA, to host target binding sites on VGAM80 host target RNA, herein designated VGAM HOST TARGET RNA, such as BINDING SITE I, BINDING SITE II and BINDING SITE III, inhibits translation of VGAM80 host target RNA, herein designated VGAM HOST TARGET RNA, into VGAM80 host target protein, herein designated VGAM HOST TARGET PROTEIN. VGAM host target protein is therefore outlined by a broken line.

It is appreciated that VGAM80 host target gene, herein designated VGAM HOST TARGET GENE, in fact represents a plurality of VGAM80 host target genes. The mRNA of each one of this plurality of VGAM80 host target genes comprises one or more host target binding sites, each having a nucleotide sequence which is at least partly complementary to VGAM80 RNA, herein designated VGAM RNA, and which when bound by VGAM80 RNA, herein designated VGAM RNA, causes inhibition of translation of respective one or more VGAM80 host target proteins.

It is further appreciated by one skilled in the art that the mode of translational inhibition illustrated by FIG. 1 with specific reference to translational inhibition exerted by VGAM80 gene, herein designated VGAM GENE, on one or more VGAM80 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM80 is inhibition of expression of host target genes, as part of a novel viral mechanism of attacking a host. Accordingly, utilities of VGAM80 include diagnosis, prevention and treatment of viral infection by Vaccinia virus. Specific functions, and accordingly utilities, of VGAM80 correlate with, and may be deduced from, the identity of the host target genes which VGAM80 binds and inhibits, and the function of these host target genes, as elaborated hereinbelow.

Nucleotide sequences of the VGAM80 precursor RNA, herein designated VGAM PRECURSOR RNA, and of the diced VGAM80 RNA, herein designated VGAM RNA, and a schematic representation of the secondary folding of VGAM80 folded precursor RNA, herein designated VGAM FOLDED PRECURSOR RNA, of VGAM80 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM80 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 81 (VGAM81) viral gene, which modulates expression of respective host target genes thereof, the function and utility of which host target genes is known in the art.

VGAM81 is a novel bioinformatically detected regulatory, non protein coding, viral micro RNA (miRNA) gene. The method by which VGAM81 was detected is described hereinabove with reference to FIGS. 2-8.

VGAM81 gene, herein designated VGAM GENE, is a viral gene contained in the genome of Vaccinia virus. VGAM81 host target gene, herein designated VGAM HOST TARGET GENE, is a human gene contained in the human genome.

VGAM81 gene, herein designated VGAM GENE, encodes a VGAM81 precursor RNA, herein designated VGAM PRECURSOR RNA. Similar to other miRNA genes, and unlike most ordinary genes, VGAM81 precursor RNA, herein designated VGAM PRECURSOR RNA, does not encode a protein. A nucleotide sequence identical or highly similar to the nucleotide sequence of VGAM81 precursor RNA is designated SEQ ID:67, and is provided hereinbelow with reference to the sequence listing part. Nucleotide sequence SEQ ID:67 is located at position 27652 relative to the genome of Vaccinia virus.

VGAM81 precursor RNA, herein designated VGAM PRECURSOR RNA, folds onto itself, forming VGAM81 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM81 folded precursor RNA, herein designated VGAM FOLDED PRECURSOR RNA, into VGAM81 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 71%) nucleotide sequence of VGAM81 RNA is designated SEQ ID:416, and is provided hereinbelow with reference to the sequence listing part.

VGAM81 host target gene, herein designated VGAM HOST TARGET GENE, encodes a corresponding messenger RNA, VGAM81 host target RNA, herein designated VGAM HOST TARGET RNA. VGAM81 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM81 RNA, herein designated VGAM RNA, binds complementarily to one or more host target binding sites located in untranslated regions of VGAM81 host target RNA, herein designated VGAM HOST TARGET RNA. This complementary binding is due to the fact that the nucleotide sequence of VGAM81 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM81 RNA, herein designated VGAM RNA, may have a different number of host target binding sites in untranslated regions of a VGAM81 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM81 RNA, herein designated VGAM RNA, to host target binding sites on VGAM81 host target RNA, herein designated VGAM HOST TARGET RNA, such as BINDING SITE I, BINDING SITE II and BINDING SITE III, inhibits translation of VGAM81 host target RNA, herein designated VGAM HOST TARGET RNA, into VGAM81 host target protein, herein designated VGAM HOST TARGET PROTEIN. VGAM host target protein is therefore outlined by a broken line.

It is appreciated that VGAM81 host target gene, herein designated VGAM HOST TARGET GENE, in fact represents a plurality of VGAM81 host target genes. The mRNA of each one of this plurality of VGAM81 host target genes comprises one or more host target binding sites, each having a nucleotide sequence which is at least partly complementary to VGAM81 RNA, herein designated VGAM RNA, and which when bound by VGAM81 RNA, herein designated VGAM RNA, causes inhibition of translation of respective one or more VGAM81 host target proteins.

It is further appreciated by one skilled in the art that the mode of translational inhibition illustrated by FIG. 1 with specific reference to translational inhibition exerted by VGAM81 gene, herein designated VGAM GENE, on one or more VGAM81 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM81 is inhibition of expression of host target genes, as part of a novel viral mechanism of attacking a host. Accordingly, utilities of VGAM81 include diagnosis, prevention and treatment of viral infection by Vaccinia virus. Specific functions, and accordingly utilities, of VGAM81 correlate with, and may be deduced from, the identity of the host target genes which VGAM81 binds and inhibits, and the function of these host target genes, as elaborated hereinbelow.

Nucleotide sequences of the VGAM81 precursor RNA, herein designated VGAM PRECURSOR RNA, and of the diced VGAM81 RNA, herein designated VGAM RNA, and a schematic representation of the secondary folding of VGAM81 folded precursor RNA, herein designated VGAM FOLDED PRECURSOR RNA, of VGAM81 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM81 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 82 (VGAM82) viral gene, which modulates expression of respective host target genes thereof, the function and utility of which host target genes is known in the art.

VGAM82 is a novel bioinformatically detected regulatory, non protein coding, viral micro RNA (miRNA) gene. The method by which VGAM82 was detected is described hereinabove with reference to FIGS. 2-8.

VGAM82 gene, herein designated VGAM GENE, is a viral gene contained in the genome of Vaccinia virus. VGAM82 host target gene, herein designated VGAM HOST TARGET GENE, is a human gene contained in the human genome.

VGAM82 gene, herein designated VGAM GENE, encodes a VGAM82 precursor RNA, herein designated VGAM PRECURSOR RNA. Similar to other miRNA genes, and unlike most ordinary genes, VGAM82 precursor RNA, herein designated VGAM PRECURSOR RNA, does not encode a protein. A nucleotide sequence identical or highly similar to the nucleotide sequence of VGAM82 precursor RNA is designated SEQ ID:68, and is provided hereinbelow with reference to the sequence listing part. Nucleotide sequence SEQ ID:68 is located at position 24541 relative to the genome of Vaccinia virus.

VGAM82 precursor RNA, herein designated VGAM PRECURSOR RNA, folds onto itself, forming VGAM82 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM82 folded precursor RNA, herein designated VGAM FOLDED PRECURSOR RNA, into VGAM82 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 86%) nucleotide sequence of VGAM82 RNA is designated SEQ ID:417, and is provided hereinbelow with reference to the sequence listing part.

VGAM82 host target gene, herein designated VGAM HOST TARGET GENE, encodes a corresponding messenger RNA, VGAM82 host target RNA, herein designated VGAM HOST TARGET RNA. VGAM82 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM82 RNA, herein designated VGAM RNA, binds complementarily to one or more host target binding sites located in untranslated regions of VGAM82 host target RNA, herein designated VGAM HOST TARGET RNA. This complementary binding is due to the fact that the nucleotide sequence of VGAM82 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM82 RNA, herein designated VGAM RNA, may have a different number of host target binding sites in untranslated regions of a VGAM82 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM82 RNA, herein designated VGAM RNA, to host target binding sites on VGAM82 host target RNA, herein designated VGAM HOST TARGET RNA, such as BINDING SITE I, BINDING SITE II and BINDING SITE III, inhibits translation of VGAM82 host target RNA, herein designated VGAM HOST TARGET RNA, into VGAM82 host target protein, herein designated VGAM HOST TARGET PROTEIN. VGAM host target protein is therefore outlined by a broken line.

It is appreciated that VGAM82 host target gene, herein designated VGAM HOST TARGET GENE, in fact represents a plurality of VGAM82 host target genes. The mRNA of each one of this plurality of VGAM82 host target genes comprises one or more host target binding sites, each having a nucleotide sequence which is at least partly complementary to VGAM82 RNA, herein designated VGAM RNA, and which when bound by VGAM82 RNA, herein designated VGAM RNA, causes inhibition of translation of respective one or more VGAM82 host target proteins.

It is further appreciated by one skilled in the art that the mode of translational inhibition illustrated by FIG. 1 with specific reference to translational inhibition exerted by VGAM82 gene, herein designated VGAM GENE, on one or more VGAM82 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM82 is inhibition of expression of host target genes, as part of a novel viral mechanism of attacking a host. Accordingly, utilities of VGAM82 include diagnosis, prevention and treatment of viral infection by Vaccinia virus. Specific functions, and accordingly utilities, of VGAM82 correlate with, and may be deduced from, the identity of the host target genes which VGAM82 binds and inhibits, and the function of these host target genes, as elaborated hereinbelow.

Nucleotide sequences of the VGAM82 precursor RNA, herein designated VGAM PRECURSOR RNA, and of the diced VGAM82 RNA, herein designated VGAM RNA, and a schematic representation of the secondary folding of VGAM82 folded precursor RNA, herein designated VGAM FOLDED PRECURSOR RNA, of VGAM82 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM82 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 83 (VGAM83) viral gene, which modulates expression of respective host target genes thereof, the function and utility of which host target genes is known in the art.

VGAM83 is a novel bioinformatically detected regulatory, non protein coding, viral micro RNA (miRNA) gene. The method by which VGAM83 was detected is described hereinabove with reference to FIGS. 2-8.

VGAM83 gene, herein designated VGAM GENE, is a viral gene contained in the genome of Vaccinia virus. VGAM83 host target gene, herein designated VGAM HOST TARGET GENE, is a human gene contained in the human genome.

VGAM83 gene, herein designated VGAM GENE, encodes a VGAM83 precursor RNA, herein designated VGAM PRECURSOR RNA. Similar to other miRNA genes, and unlike most ordinary genes, VGAM83 precursor RNA, herein designated VGAM PRECURSOR RNA, does not encode a protein. A nucleotide sequence identical or highly similar to the nucleotide sequence of VGAM83 precursor RNA is designated SEQ ID:69, and is provided hereinbelow with reference to the sequence listing part. Nucleotide sequence SEQ ID:69 is located at position 23600 relative to the genome of Vaccinia virus.

VGAM83 precursor RNA, herein designated VGAM PRECURSOR RNA, folds onto itself, forming VGAM83 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM83 folded precursor RNA, herein designated VGAM FOLDED PRECURSOR RNA, into VGAM83 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM83 RNA is designated SEQ ID:418, and is provided hereinbelow with reference to the sequence listing part.

VGAM83 host target gene, herein designated VGAM HOST TARGET GENE, encodes a corresponding messenger RNA, VGAM83 host target RNA, herein designated VGAM HOST TARGET RNA. VGAM83 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM83 RNA, herein designated VGAM RNA, binds complementarily to one or more host target binding sites located in untranslated regions of VGAM83 host target RNA, herein designated VGAM HOST TARGET RNA. This complementary binding is due to the fact that the nucleotide sequence of VGAM83 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM83 RNA, herein designated VGAM RNA, may have a different number of host target binding sites in untranslated regions of a VGAM83 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM83 RNA, herein designated VGAM RNA, to host target binding sites on VGAM83 host target RNA, herein designated VGAM HOST TARGET RNA, such as BINDING SITE I, BINDING SITE II and BINDING SITE III, inhibits translation of VGAM83 host target RNA, herein designated VGAM HOST TARGET RNA, into VGAM83 host target protein, herein designated VGAM HOST TARGET PROTEIN. VGAM host target protein is therefore outlined by a broken line.

It is appreciated that VGAM83 host target gene, herein designated VGAM HOST TARGET GENE, in fact represents a plurality of VGAM83 host target genes. The mRNA of each one of this plurality of VGAM83 host target genes comprises one or more host target binding sites, each having a nucleotide sequence which is at least partly complementary to VGAM83 RNA, herein designated VGAM RNA, and which when bound by VGAM83 RNA, herein designated VGAM RNA, causes inhibition of translation of respective one or more VGAM83 host target proteins.

It is further appreciated by one skilled in the art that the mode of translational inhibition illustrated by FIG. 1 with specific reference to translational inhibition exerted by VGAM83 gene, herein designated VGAM GENE, on one or more VGAM83 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM83 is inhibition of expression of host target genes, as part of a novel viral mechanism of attacking a host. Accordingly, utilities of VGAM83 include diagnosis, prevention and treatment of viral infection by Vaccinia virus. Specific functions, and accordingly utilities, of VGAM83 correlate with, and may be deduced from, the identity of the host target genes which VGAM83 binds and inhibits, and the function of these host target genes, as elaborated hereinbelow.

Nucleotide sequences of the VGAM83 precursor RNA, herein designated VGAM PRECURSOR RNA, and of the diced VGAM83 RNA, herein designated VGAM RNA, and a schematic representation of the secondary folding of VGAM83 folded precursor RNA, herein designated VGAM FOLDED PRECURSOR RNA, of VGAM83 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM83 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 84 (VGAM84) viral gene, which modulates expression of respective host target genes thereof, the function and utility of which host target genes is known in the art.

VGAM84 is a novel bioinformatically detected regulatory, non protein coding, viral micro RNA (miRNA) gene. The method by which VGAM84 was detected is described hereinabove with reference to FIGS. 2-8.

VGAM84 gene, herein designated VGAM GENE, is a viral gene contained in the genome of Vaccinia virus. VGAM84 host target gene, herein designated VGAM HOST TARGET GENE, is a human gene contained in the human genome.

VGAM84 gene, herein designated VGAM GENE, encodes a VGAM84 precursor RNA, herein designated VGAM PRECURSOR RNA. Similar to other miRNA genes, and unlike most ordinary genes, VGAM84 precursor RNA, herein designated VGAM PRECURSOR RNA, does not encode a protein. A nucleotide sequence identical or highly similar to the nucleotide sequence of VGAM84 precursor RNA is designated SEQ ID:70, and is provided hereinbelow with reference to the sequence listing part. Nucleotide sequence SEQ ID:70 is located at position 27761 relative to the genome of Vaccinia virus.

VGAM84 precursor RNA, herein designated VGAM PRECURSOR RNA, folds onto itself, forming VGAM84 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM84 folded precursor RNA, herein designated VGAM FOLDED PRECURSOR RNA, into VGAM84 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM84 RNA is designated SEQ ID:419, and is provided hereinbelow with reference to the sequence listing part.

VGAM84 host target gene, herein designated VGAM HOST TARGET GENE, encodes a corresponding messenger RNA, VGAM84 host target RNA, herein designated VGAM HOST TARGET RNA. VGAM84 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM84 RNA, herein designated VGAM RNA, binds complementarily to one or more host target binding sites located in untranslated regions of VGAM84 host target RNA, herein designated VGAM HOST TARGET RNA. This complementary binding is due to the fact that the nucleotide sequence of VGAM84 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM84 RNA, herein designated VGAM RNA, may have a different number of host target binding sites in untranslated regions of a VGAM84 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM84 RNA, herein designated VGAM RNA, to host target binding sites on VGAM84 host target RNA, herein designated VGAM HOST TARGET RNA, such as BINDING SITE I, BINDING SITE II and BINDING SITE III, inhibits translation of VGAM84 host target RNA, herein designated VGAM HOST TARGET RNA, into VGAM84 host target protein, herein designated VGAM HOST TARGET PROTEIN. VGAM host target protein is therefore outlined by a broken line.

It is appreciated that VGAM84 host target gene, herein designated VGAM HOST TARGET GENE, in fact represents a plurality of VGAM84 host target genes. The mRNA of each one of this plurality of VGAM84 host target genes comprises one or more host target binding sites, each having a nucleotide sequence which is at least partly complementary to VGAM84 RNA, herein designated VGAM RNA, and which when bound by VGAM84 RNA, herein designated VGAM RNA, causes inhibition of translation of respective one or more VGAM84 host target proteins.

It is further appreciated by one skilled in the art that the mode of translational inhibition illustrated by FIG. 1 with specific reference to translational inhibition exerted by VGAM84 gene, herein designated VGAM GENE, on one or more VGAM84 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM84 is inhibition of expression of host target genes, as part of a novel viral mechanism of attacking a host. Accordingly, utilities of VGAM84 include diagnosis, prevention and treatment of viral infection by Vaccinia virus. Specific functions, and accordingly utilities, of VGAM84 correlate with, and may be deduced from, the identity of the host target genes which VGAM84 binds and inhibits, and the function of these host target genes, as elaborated hereinbelow.

Nucleotide sequences of the VGAM84 precursor RNA, herein designated VGAM PRECURSOR RNA, and of the diced VGAM84 RNA, herein designated VGAM RNA, and a schematic representation of the secondary folding of VGAM84 folded precursor RNA, herein designated VGAM FOLDED PRECURSOR RNA, of VGAM84 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM84 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 85 (VGAM85) viral gene, which modulates expression of respective host target genes thereof, the function and utility of which host target genes is known in the art.

VGAM85 is a novel bioinformatically detected regulatory, non protein coding, viral micro RNA (miRNA) gene. The method by which VGAM85 was detected is described hereinabove with reference to FIGS. 2-8.

VGAM85 gene, herein designated VGAM GENE, is a viral gene contained in the genome of Vaccinia virus. VGAM85 host target gene, herein designated VGAM HOST TARGET GENE, is a human gene contained in the human genome.

VGAM85 gene, herein designated VGAM GENE, encodes a VGAM85 precursor RNA, herein designated VGAM PRECURSOR RNA. Similar to other miRNA genes, and unlike most ordinary genes, VGAM85 precursor RNA, herein designated VGAM PRECURSOR RNA, does not encode a protein. A nucleotide sequence identical or highly similar to the nucleotide sequence of VGAM85 precursor RNA is designated SEQ ID:71, and is provided hereinbelow with reference to the sequence listing part. Nucleotide sequence SEQ ID:71 is located at position 26098 relative to the genome of Vaccinia virus.

VGAM85 precursor RNA, herein designated VGAM PRECURSOR RNA, folds onto itself, forming VGAM85 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM85 folded precursor RNA, herein designated VGAM FOLDED PRECURSOR RNA, into VGAM85 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 90%) nucleotide sequence of VGAM85 RNA is designated SEQ ID:420, and is provided hereinbelow with reference to the sequence listing part.

VGAM85 host target gene, herein designated VGAM HOST TARGET GENE, encodes a corresponding messenger RNA, VGAM85 host target RNA, herein designated VGAM HOST TARGET RNA. VGAM85 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM85 RNA, herein designated VGAM RNA, binds complementarily to one or more host target binding sites located in untranslated regions of VGAM85 host target RNA, herein designated VGAM HOST TARGET RNA. This complementary binding is due to the fact that the nucleotide sequence of VGAM85 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM85 RNA, herein designated VGAM RNA, may have a different number of host target binding sites in untranslated regions of a VGAM85 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM85 RNA, herein designated VGAM RNA, to host target binding sites on VGAM85 host target RNA, herein designated VGAM HOST TARGET RNA, such as BINDING SITE I, BINDING SITE II and BINDING SITE III, inhibits translation of VGAM85 host target RNA, herein designated VGAM HOST TARGET RNA, into VGAM85 host target protein, herein designated VGAM HOST TARGET PROTEIN. VGAM host target protein is therefore outlined by a broken line.

It is appreciated that VGAM85 host target gene, herein designated VGAM HOST TARGET GENE, in fact represents a plurality of VGAM85 host target genes. The mRNA of each one of this plurality of VGAM85 host target genes comprises one or more host target binding sites, each having a nucleotide sequence which is at least partly complementary to VGAM85 RNA, herein designated VGAM RNA, and which when bound by VGAM85 RNA, herein designated VGAM RNA, causes inhibition of translation of respective one or more VGAM85 host target proteins.

It is further appreciated by one skilled in the art that the mode of translational inhibition illustrated by FIG. 1 with specific reference to translational inhibition exerted by VGAM85 gene, herein designated VGAM GENE, on one or more VGAM85 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM85 is inhibition of expression of host target genes, as part of a novel viral mechanism of attacking a host. Accordingly, utilities of VGAM85 include diagnosis, prevention and treatment of viral infection by Vaccinia virus. Specific functions, and accordingly utilities, of VGAM85 correlate with, and may be deduced from, the identity of the host target genes which VGAM85 binds and inhibits, and the function of these host target genes, as elaborated hereinbelow.

Nucleotide sequences of the VGAM85 precursor RNA, herein designated VGAM PRECURSOR RNA, and of the diced VGAM85 RNA, herein designated VGAM RNA, and a schematic representation of the secondary folding of VGAM85 folded precursor RNA, herein designated VGAM FOLDED PRECURSOR RNA, of VGAM85 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM85 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 86 (VGAM86) viral gene, which modulates expression of respective host target genes thereof, the function and utility of which host target genes is known in the art.

VGAM86 is a novel bioinformatically detected regulatory, non protein coding, viral micro RNA (miRNA) gene. The method by which VGAM86 was detected is described hereinabove with reference to FIGS. 2-8.

VGAM86 gene, herein designated VGAM GENE, is a viral gene contained in the genome of Vaccinia virus. VGAM86 host target gene, herein designated VGAM HOST TARGET GENE, is a human gene contained in the human genome.

VGAM86 gene, herein designated VGAM GENE, encodes a VGAM86 precursor RNA, herein designated VGAM PRECURSOR RNA. Similar to other miRNA genes, and unlike most ordinary genes, VGAM86 precursor RNA, herein designated VGAM PRECURSOR RNA, does not encode a protein. A nucleotide sequence identical or highly similar to the nucleotide sequence of VGAM86 precursor RNA is designated SEQ ID:72, and is provided hereinbelow with reference to the sequence listing part. Nucleotide sequence SEQ ID:72 is located at position 25950 relative to the genome of Vaccinia virus.

VGAM86 precursor RNA, herein designated VGAM PRECURSOR RNA, folds onto itself, forming VGAM86 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM86 folded precursor RNA, herein designated VGAM FOLDED PRECURSOR RNA, into VGAM86 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 89%) nucleotide sequence of VGAM86 RNA is designated SEQ ID:421, and is provided hereinbelow with reference to the sequence listing part.

VGAM86 host target gene, herein designated VGAM HOST TARGET GENE, encodes a corresponding messenger RNA, VGAM86 host target RNA, herein designated VGAM HOST TARGET RNA. VGAM86 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM86 RNA, herein designated VGAM RNA, binds complementarily to one or more host target binding sites located in untranslated regions of VGAM86 host target RNA, herein designated VGAM HOST TARGET RNA. This complementary binding is due to the fact that the nucleotide sequence of VGAM86 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM86 RNA, herein designated VGAM RNA, may have a different number of host target binding sites in untranslated regions of a VGAM86 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM86 RNA, herein designated VGAM RNA, to host target binding sites on VGAM86 host target RNA, herein designated VGAM HOST TARGET RNA, such as BINDING SITE I, BINDING SITE II and BINDING SITE III, inhibits translation of VGAM86 host target RNA, herein designated VGAM HOST TARGET RNA, into VGAM86 host target protein, herein designated VGAM HOST TARGET PROTEIN. VGAM host target protein is therefore outlined by a broken line.

It is appreciated that VGAM86 host target gene, herein designated VGAM HOST TARGET GENE, in fact represents a plurality of VGAM86 host target genes. The mRNA of each one of this plurality of VGAM86 host target genes comprises one or more host target binding sites, each having a nucleotide sequence which is at least partly complementary to VGAM86 RNA, herein designated VGAM RNA, and which when bound by VGAM86 RNA, herein designated VGAM RNA, causes inhibition of translation of respective one or more VGAM86 host target proteins.

It is further appreciated by one skilled in the art that the mode of translational inhibition illustrated by FIG. 1 with specific reference to translational inhibition exerted by VGAM86 gene, herein designated VGAM GENE, on one or more VGAM86 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM86 is inhibition of expression of host target genes, as part of a novel viral mechanism of attacking a host. Accordingly, utilities of VGAM86 include diagnosis, prevention and treatment of viral infection by Vaccinia virus. Specific functions, and accordingly utilities of VGAM86 correlate with, and may be deduced from, the identity of the host target genes which VGAM86 binds and inhibits, and the function of these host target genes, as elaborated hereinbelow.

Nucleotide sequences of the VGAM86 precursor RNA, herein designated VGAM PRECURSOR RNA, and of the diced VGAM86 RNA, herein designated VGAM RNA, and a schematic representation of the secondary folding of VGAM86 folded precursor RNA, herein designated VGAM FOLDED PRECURSOR RNA, of VGAM86 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM86 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 87 (VGAM87) viral gene, which modulates expression of respective host target genes thereof, the function and utility of which host target genes is known in the art.

VGAM87 is a novel bioinformatically detected regulatory, non protein coding, viral micro RNA (miRNA) gene. The method by which VGAM87 was detected is described hereinabove with reference to FIGS. 2-8.

VGAM87 gene, herein designated VGAM GENE, is a viral gene contained in the genome of Vaccinia virus. VGAM87 host target gene, herein designated VGAM HOST TARGET GENE, is a human gene contained in the human genome.

VGAM87 gene, herein designated VGAM GENE, encodes a VGAM87 precursor RNA, herein designated VGAM PRECURSOR RNA. Similar to other miRNA genes, and unlike most ordinary genes, VGAM87 precursor RNA, herein designated VGAM PRECURSOR RNA, does not encode a protein. A nucleotide sequence identical or highly similar to the nucleotide sequence of VGAM87 precursor RNA is designated SEQ ID:73, and is provided hereinbelow with reference to the sequence listing part. Nucleotide sequence SEQ ID:73 is located at position 28644 relative to the genome of Vaccinia virus.

VGAM87 precursor RNA, herein designated VGAM PRECURSOR RNA, folds onto itself, forming VGAM87 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM87 folded precursor RNA, herein designated VGAM FOLDED PRECURSOR RNA, into VGAM87 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 72%) nucleotide sequence of VGAM87 RNA is designated SEQ ID:422, and is provided hereinbelow with reference to the sequence listing part.

VGAM87 host target gene, herein designated VGAM HOST TARGET GENE, encodes a corresponding messenger RNA, VGAM87 host target RNA, herein designated VGAM HOST TARGET RNA. VGAM87 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM87 RNA, herein designated VGAM RNA, binds complementarily to one or more host target binding sites located in untranslated regions of VGAM87 host target RNA, herein designated VGAM HOST TARGET RNA. This complementary binding is due to the fact that the nucleotide sequence of VGAM87 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM87 RNA, herein designated VGAM RNA, may have a different number of host target binding sites in untranslated regions of a VGAM87 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM87 RNA, herein designated VGAM RNA, to host target binding sites on VGAM87 host target RNA, herein designated VGAM HOST TARGET RNA, such as BINDING SITE I, BINDING SITE II and BINDING SITE III, inhibits translation of VGAM87 host target RNA, herein designated VGAM HOST TARGET RNA, into VGAM87 host target protein, herein designated VGAM HOST TARGET PROTEIN. VGAM host target protein is therefore outlined by a broken line.

It is appreciated that VGAM87 host target gene, herein designated VGAM HOST TARGET GENE, in fact represents a plurality of VGAM87 host target genes. The mRNA of each one of this plurality of VGAM87 host target genes comprises one or more host target binding sites, each having a nucleotide sequence which is at least partly complementary to VGAM87 RNA, herein designated VGAM RNA, and which when bound by VGAM87 RNA, herein designated VGAM RNA, causes inhibition of translation of respective one or more VGAM87 host target proteins.

It is further appreciated by one skilled in the art that the mode of translational inhibition illustrated by FIG. 1 with specific reference to translational inhibition exerted by VGAM87 gene, herein designated VGAM GENE, on one or more VGAM87 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM87 is inhibition of expression of host target genes, as part of a novel viral mechanism of attacking a host. Accordingly, utilities of VGAM87 include diagnosis, prevention and treatment of viral infection by Vaccinia virus. Specific functions, and accordingly utilities, of VGAM87 correlate with, and may be deduced from, the identity of the host target genes which VGAM87 binds and inhibits, and the function of these host target genes, as elaborated hereinbelow.

Nucleotide sequences of the VGAM87 precursor RNA, herein designated VGAM PRECURSOR RNA, and of the diced VGAM87 RNA, herein designated VGAM RNA, and a schematic representation of the secondary folding of VGAM87 folded precursor RNA, herein designated VGAM FOLDED PRECURSOR RNA, of VGAM87 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM87 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 88 (VGAM88) viral gene, which modulates expression of respective host target genes thereof, the function and utility of which host target genes is known in the art.

VGAM88 is a novel bioinformatically detected regulatory, non protein coding, viral micro RNA (miRNA) gene. The method by which VGAM88 was detected is described hereinabove with reference to FIGS. 2-8.

VGAM88 gene, herein designated VGAM GENE, is a viral gene contained in the genome of Vaccinia virus. VGAM88 host target gene, herein designated VGAM HOST TARGET GENE, is a human gene contained in the human genome.

VGAM88 gene, herein designated VGAM GENE, encodes a VGAM88 precursor RNA, herein designated VGAM PRECURSOR RNA. Similar to other miRNA genes, and unlike most ordinary genes, VGAM88 precursor RNA, herein designated VGAM PRECURSOR RNA, does not encode a protein. A nucleotide sequence identical or highly similar to the nucleotide sequence of VGAM88 precursor RNA is designated SEQ ID:74, and is provided hereinbelow with reference to the sequence listing part. Nucleotide sequence SEQ ID:74 is located at position 29293 relative to the genome of Vaccinia virus.

VGAM88 precursor RNA, herein designated VGAM PRECURSOR RNA, folds onto itself, forming VGAM88 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM88 folded precursor RNA, herein designated VGAM FOLDED PRECURSOR RNA, into VGAM88 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM88 RNA is designated SEQ ID:423, and is provided hereinbelow with reference to the sequence listing part.

VGAM88 host target gene, herein designated VGAM HOST TARGET GENE, encodes a corresponding messenger RNA, VGAM88 host target RNA, herein designated VGAM HOST TARGET RNA. VGAM88 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM88 RNA, herein designated VGAM RNA, binds complementarily to one or more host target binding sites located in untranslated regions of VGAM88 host target RNA, herein designated VGAM HOST TARGET RNA. This complementary binding is due to the fact that the nucleotide sequence of VGAM88 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM88 RNA, herein designated VGAM RNA, may have a different number of host target binding sites in untranslated regions of a VGAM88 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM88 RNA, herein designated VGAM RNA, to host target binding sites on VGAM88 host target RNA, herein designated VGAM HOST TARGET RNA, such as BINDING SITE I, BINDING SITE II and BINDING SITE III, inhibits translation of VGAM88 host target RNA, herein designated VGAM HOST TARGET RNA, into VGAM88 host target protein, herein designated VGAM HOST TARGET PROTEIN. VGAM host target protein is therefore outlined by a broken line.

It is appreciated that VGAM88 host target gene, herein designated VGAM HOST TARGET GENE, in fact represents a plurality of VGAM88 host target genes. The mRNA of each one of this plurality of VGAM88 host target genes comprises one or more host target binding sites, each having a nucleotide sequence which is at least partly complementary to VGAM88 RNA, herein designated VGAM RNA, and which when bound by VGAM88 RNA, herein designated VGAM RNA, causes inhibition of translation of respective one or more VGAM88 host target proteins.

It is further appreciated by one skilled in the art that the mode of translational inhibition illustrated by FIG. 1 with specific reference to translational inhibition exerted by VGAM88 gene, herein designated VGAM GENE, on one or more VGAM88 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM88 is inhibition of expression of host target genes, as part of a novel viral mechanism of attacking a host. Accordingly, utilities of VGAM88 include diagnosis, prevention and treatment of viral infection by Vaccinia virus. Specific functions, and accordingly utilities, of VGAM88 correlate with, and may be deduced from, the identity of the host target genes which VGAM88 binds and inhibits, and the function of these host target genes, as elaborated hereinbelow.

Nucleotide sequences of the VGAM88 precursor RNA, herein designated VGAM PRECURSOR RNA, and of the diced VGAM88 RNA, herein designated VGAM RNA, and a schematic representation of the secondary folding of VGAM88 folded precursor RNA, herein designated VGAM FOLDED PRECURSOR RNA, of VGAM88 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM88 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 89 (VGAM89) viral gene, which modulates expression of respective host target genes thereof, the function and utility of which host target genes is known in the art.

VGAM89 is a novel bioinformatically detected regulatory, non protein coding, viral micro RNA (miRNA) gene. The method by which VGAM89 was detected is described hereinabove with reference to FIGS. 2-8.

VGAM89 gene, herein designated VGAM GENE, is a viral gene contained in the genome of Vaccinia virus. VGAM89 host target gene, herein designated VGAM HOST TARGET GENE, is a human gene contained in the human genome.

VGAM89 gene, herein designated VGAM GENE, encodes a VGAM89 precursor RNA, herein designated VGAM PRECURSOR RNA. Similar to other miRNA genes, and unlike most ordinary genes, VGAM89 precursor RNA, herein designated VGAM PRECURSOR RNA, does not encode a protein. A nucleotide sequence identical or highly similar to the nucleotide sequence of VGAM89 precursor RNA is designated SEQ ID:75, and is provided hereinbelow with reference to the sequence listing part. Nucleotide sequence SEQ ID:75 is located at position 25248 relative to the genome of Vaccinia virus.

VGAM89 precursor RNA, herein designated VGAM PRECURSOR RNA, folds onto itself, forming VGAM89 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM89 folded precursor RNA, herein designated VGAM FOLDED PRECURSOR RNA, into VGAM89 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM89 RNA is designated SEQ ID:424, and is provided hereinbelow with reference to the sequence listing part.

VGAM89 host target gene, herein designated VGAM HOST TARGET GENE, encodes a corresponding messenger RNA, VGAM89 host target RNA, herein designated VGAM HOST TARGET RNA. VGAM89 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM89 RNA, herein designated VGAM RNA, binds complementarily to one or more host target binding sites located in untranslated regions of VGAM89 host target RNA, herein designated VGAM HOST TARGET RNA. This complementary binding is due to the fact that the nucleotide sequence of VGAM89 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM89 RNA, herein designated VGAM RNA, may have a different number of host target binding sites in untranslated regions of a VGAM89 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM89 RNA, herein designated VGAM RNA, to host target binding sites on VGAM89 host target RNA, herein designated VGAM HOST TARGET RNA, such as BINDING SITE I, BINDING SITE II and BINDING SITE III, inhibits translation of VGAM89 host target RNA, herein designated VGAM HOST TARGET RNA, into VGAM89 host target protein, herein designated VGAM HOST TARGET PROTEIN. VGAM host target protein is therefore outlined by a broken line.

It is appreciated that VGAM89 host target gene, herein designated VGAM HOST TARGET GENE, in fact represents a plurality of VGAM89 host target genes. The mRNA of each one of this plurality of VGAM89 host target genes comprises one or more host target binding sites, each having a nucleotide sequence which is at least partly complementary to VGAM89 RNA, herein designated VGAM RNA, and which when bound by VGAM89 RNA, herein designated VGAM RNA, causes inhibition of translation of respective one or more VGAM89 host target proteins.

It is further appreciated by one skilled in the art that the mode of translational inhibition illustrated by FIG. 1 with specific reference to translational inhibition exerted by VGAM89 gene, herein designated VGAM GENE, on one or more VGAM89 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM89 is inhibition of expression of host target genes, as part of a novel viral mechanism of attacking a host. Accordingly, utilities of VGAM89 include diagnosis, prevention and treatment of viral infection by Vaccinia virus. Specific functions, and accordingly utilities, of VGAM89 correlate with, and may be deduced from, the identity of the host target genes which VGAM89 binds and inhibits, and the function of these host target genes, as elaborated hereinbelow.

Nucleotide sequences of the VGAM89 precursor RNA, herein designated VGAM PRECURSOR RNA, and of the diced VGAM89 RNA, herein designated VGAM RNA, and a schematic representation of the secondary folding of VGAM89 folded precursor RNA, herein designated VGAM FOLDED PRECURSOR RNA, of VGAM89 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM89 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 90 (VGAM90) viral gene, which modulates expression of respective host target genes thereof, the function and utility of which host target genes is known in the art.

VGAM90 is a novel bioinformatically detected regulatory, non protein coding, viral micro RNA (miRNA) gene. The method by which VGAM90 was detected is described hereinabove with reference to FIGS. 2-8.

VGAM90 gene, herein designated VGAM GENE, is a viral gene contained in the genome of Vaccinia virus. VGAM90 host target gene, herein designated VGAM HOST TARGET GENE, is a human gene contained in the human genome.

VGAM90 gene, herein designated VGAM GENE, encodes a VGAM90 precursor RNA, herein designated VGAM PRECURSOR RNA. Similar to other miRNA genes, and unlike most ordinary genes, VGAM90 precursor RNA, herein designated VGAM PRECURSOR RNA, does not encode a protein. A nucleotide sequence identical or highly similar to the nucleotide sequence of VGAM90 precursor RNA is designated SEQ ID:76, and is provided hereinbelow with reference to the sequence listing part. Nucleotide sequence SEQ ID:76 is located at position 29027 relative to the genome of Vaccinia virus.

VGAM90 precursor RNA, herein designated VGAM PRECURSOR RNA, folds onto itself, forming VGAM90 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM90 folded precursor RNA, herein designated VGAM FOLDED PRECURSOR RNA, into VGAM90 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 76%) nucleotide sequence of VGAM90 RNA is designated SEQ ID:425, and is provided hereinbelow with reference to the sequence listing part.

VGAM90 host target gene, herein designated VGAM HOST TARGET GENE, encodes a corresponding messenger RNA, VGAM90 host target RNA, herein designated VGAM HOST TARGET RNA. VGAM90 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM90 RNA, herein designated VGAM RNA, binds complementarily to one or more host target binding sites located in untranslated regions of VGAM90 host target RNA, herein designated VGAM HOST TARGET RNA. This complementary binding is due to the fact that the nucleotide sequence of VGAM90 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM90 RNA, herein designated VGAM RNA, may have a different number of host target binding sites in untranslated regions of a VGAM90 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM90 RNA, herein designated VGAM RNA, to host target binding sites on VGAM90 host target RNA, herein designated VGAM HOST TARGET RNA, such as BINDING SITE I, BINDING SITE II and BINDING SITE III, inhibits translation of VGAM90 host target RNA, herein designated VGAM HOST TARGET RNA, into VGAM90 host target protein, herein designated VGAM HOST TARGET PROTEIN. VGAM host target protein is therefore outlined by a broken line.

It is appreciated that VGAM90 host target gene, herein designated VGAM HOST TARGET GENE, in fact represents a plurality of VGAM90 host target genes. The mRNA of each one of this plurality of VGAM90 host target genes comprises one or more host target binding sites, each having a nucleotide sequence which is at least partly complementary to VGAM90 RNA, herein designated VGAM RNA, and which when bound by VGAM90 RNA, herein designated VGAM RNA, causes inhibition of translation of respective one or more VGAM90 host target proteins.

It is further appreciated by one skilled in the art that the mode of translational inhibition illustrated by FIG. 1 with specific reference to translational inhibition exerted by VGAM90 gene, herein designated VGAM GENE, on one or more VGAM90 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM90 is inhibition of expression of host target genes, as part of a novel viral mechanism of attacking a host. Accordingly, utilities of VGAM90 include diagnosis, prevention and treatment of viral infection by Vaccinia virus. Specific functions, and accordingly utilities, of VGAM90 correlate with, and may be deduced from, the identity of the host target genes which VGAM90 binds and inhibits, and the function of these host target genes, as elaborated hereinbelow.

Nucleotide sequences of the VGAM90 precursor RNA, herein designated VGAM PRECURSOR RNA, and of the diced VGAM90 RNA, herein designated VGAM RNA, and a schematic representation of the secondary folding of VGAM90 folded precursor RNA, herein designated VGAM FOLDED PRECURSOR RNA, of VGAM90 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM90 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 91 (VGAM91) viral gene, which modulates expression of respective host target genes thereof, the function and utility of which host target genes is known in the art.

VGAM91 is a novel bioinformatically detected regulatory, non protein coding, viral micro RNA (miRNA) gene. The method by which VGAM91 was detected is described hereinabove with reference to FIGS. 2-8.

VGAM91 gene, herein designated VGAM GENE, is a viral gene contained in the genome of Vaccinia virus. VGAM91 host target gene, herein designated VGAM HOST TARGET GENE, is a human gene contained in the human genome.

VGAM91 gene, herein designated VGAM GENE, encodes a VGAM91 precursor RNA, herein designated VGAM PRECURSOR RNA. Similar to other miRNA genes, and unlike most ordinary genes, VGAM91 precursor RNA, herein designated VGAM PRECURSOR RNA, does not encode a protein. A nucleotide sequence identical or highly similar to the nucleotide sequence of VGAM91 precursor RNA is designated SEQ ID:77, and is provided hereinbelow with reference to the sequence listing part. Nucleotide sequence SEQ ID:77 is located at position 32319 relative to the genome of Vaccinia virus.

VGAM91 precursor RNA, herein designated VGAM PRECURSOR RNA, folds onto itself, forming VGAM91 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM91 folded precursor RNA, herein designated VGAM FOLDED PRECURSOR RNA, into VGAM91 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM91 RNA is designated SEQ ID:426, and is provided hereinbelow with reference to the sequence listing part.

VGAM91 host target gene, herein designated VGAM HOST TARGET GENE, encodes a corresponding messenger RNA, VGAM91 host target RNA, herein designated VGAM HOST TARGET RNA. VGAM91 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM91 RNA, herein designated VGAM RNA, binds complementarily to one or more host target binding sites located in untranslated regions of VGAM91 host target RNA, herein designated VGAM HOST TARGET RNA. This complementary binding is due to the fact that the nucleotide sequence of VGAM91 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM91 RNA, herein designated VGAM RNA, may have a different number of host target binding sites in untranslated regions of a VGAM91 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM91 RNA, herein designated VGAM RNA, to host target binding sites on VGAM91 host target RNA, herein designated VGAM HOST TARGET RNA, such as BINDING SITE I, BINDING SITE II and BINDING SITE III, inhibits translation of VGAM91 host target RNA, herein designated VGAM HOST TARGET RNA, into VGAM91 host target protein, herein designated VGAM HOST TARGET PROTEIN. VGAM host target protein is therefore outlined by a broken line.

It is appreciated that VGAM91 host target gene, herein designated VGAM HOST TARGET GENE, in fact represents a plurality of VGAM91 host target genes. The mRNA of each one of this plurality of VGAM91 host target genes comprises one or more host target binding sites, each having a nucleotide sequence which is at least partly complementary to VGAM91 RNA, herein designated VGAM RNA, and which when bound by VGAM91 RNA, herein designated VGAM RNA, causes inhibition of translation of respective one or more VGAM91 host target proteins.

It is further appreciated by one skilled in the art that the mode of translational inhibition illustrated by FIG. 1 with specific reference to translational inhibition exerted by VGAM91 gene, herein designated VGAM GENE, on one or more VGAM91 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM91 is inhibition of expression of host target genes, as part of a novel viral mechanism of attacking a host. Accordingly, utilities of VGAM91 include diagnosis, prevention and treatment of viral infection by Vaccinia virus. Specific functions, and accordingly utilities, of VGAM91 correlate with, and may be deduced from, the identity of the host target genes which VGAM91 binds and inhibits, and the function of these host target genes, as elaborated hereinbelow.

Nucleotide sequences of the VGAM91 precursor RNA, herein designated VGAM PRECURSOR RNA, and of the diced VGAM91 RNA, herein designated VGAM RNA, and a schematic representation of the secondary folding of VGAM91 folded precursor RNA, herein designated VGAM FOLDED PRECURSOR RNA, of VGAM91 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM91 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 92 (VGAM92) viral gene, which modulates expression of respective host target genes thereof, the function and utility of which host target genes is known in the art.

VGAM92 is a novel bioinformatically detected regulatory, non protein coding, viral micro RNA (miRNA) gene. The method by which VGAM92 was detected is described hereinabove with reference to FIGS. 2-8.

VGAM92 gene, herein designated VGAM GENE, is a viral gene contained in the genome of Vaccinia virus. VGAM92 host target gene, herein designated VGAM HOST TARGET GENE, is a human gene contained in the human genome.

VGAM92 gene, herein designated VGAM GENE, encodes a VGAM92 precursor RNA, herein designated VGAM PRECURSOR RNA. Similar to other miRNA genes, and unlike most ordinary genes, VGAM92 precursor RNA, herein designated VGAM PRECURSOR RNA, does not encode a protein. A nucleotide sequence identical or highly similar to the nucleotide sequence of VGAM92 precursor RNA is designated SEQ ID:78, and is provided hereinbelow with reference to the sequence listing part. Nucleotide sequence SEQ ID:78 is located at position 31579 relative to the genome of Vaccinia virus.

VGAM92 precursor RNA, herein designated VGAM PRECURSOR RNA, folds onto itself, forming VGAM92 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM92 folded precursor RNA, herein designated VGAM FOLDED PRECURSOR RNA, into VGAM92 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 76%) nucleotide sequence of VGAM92 RNA is designated SEQ ID:427, and is provided hereinbelow with reference to the sequence listing part.

VGAM92 host target gene, herein designated VGAM HOST TARGET GENE, encodes a corresponding messenger RNA, VGAM92 host target RNA, herein designated VGAM HOST TARGET RNA. VGAM92 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM92 RNA, herein designated VGAM RNA, binds complementarily to one or more host target binding sites located in untranslated regions of VGAM92 host target RNA, herein designated VGAM HOST TARGET RNA. This complementary binding is due to the fact that the nucleotide sequence of VGAM92 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM92 RNA, herein designated VGAM RNA, may have a different number of host target binding sites in untranslated regions of a VGAM92 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM92 RNA, herein designated VGAM RNA, to host target binding sites on VGAM92 host target RNA, herein designated VGAM HOST TARGET RNA, such as BINDING SITE I, BINDING SITE II and BINDING SITE III, inhibits translation of VGAM92 host target RNA, herein designated VGAM HOST TARGET RNA, into VGAM92 host target protein, herein designated VGAM HOST TARGET PROTEIN. VGAM host target protein is therefore outlined by a broken line.

It is appreciated that VGAM92 host target gene, herein designated VGAM HOST TARGET GENE, in fact represents a plurality of VGAM92 host target genes. The mRNA of each one of this plurality of VGAM92 host target genes comprises one or more host target binding sites, each having a nucleotide sequence which is at least partly complementary to VGAM92 RNA, herein designated VGAM RNA, and which when bound by VGAM92 RNA, herein designated VGAM RNA, causes inhibition of translation of respective one or more VGAM92 host target proteins.

It is further appreciated by one skilled in the art that the mode of translational inhibition illustrated by FIG. 1 with specific reference to translational inhibition exerted by VGAM92 gene, herein designated VGAM GENE, on one or more VGAM92 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM92 is inhibition of expression of host target genes, as part of a novel viral mechanism of attacking a host. Accordingly, utilities of VGAM92 include diagnosis, prevention and treatment of viral infection by Vaccinia virus. Specific functions, and accordingly utilities, of VGAM92 correlate with, and may be deduced from, the identity of the host target genes which VGAM92 binds and inhibits, and the function of these host target genes, as elaborated hereinbelow.

Nucleotide sequences of the VGAM92 precursor RNA, herein designated VGAM PRECURSOR RNA, and of the diced VGAM92 RNA, herein designated VGAM RNA, and a schematic representation of the secondary folding of VGAM92 folded precursor RNA, herein designated VGAM FOLDED PRECURSOR RNA, of VGAM92 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM92 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 93 (VGAM93) viral gene, which modulates expression of respective host target genes thereof, the function and utility of which host target genes is known in the art.

VGAM93 is a novel bioinformatically detected regulatory, non protein coding, viral micro RNA (miRNA) gene. The method by which VGAM93 was detected is described hereinabove with reference to FIGS. 2-8.

VGAM93 gene, herein designated VGAM GENE, is a viral gene contained in the genome of Vaccinia virus. VGAM93 host target gene, herein designated VGAM HOST TARGET GENE, is a human gene contained in the human genome.

VGAM93 gene, herein designated VGAM GENE, encodes a VGAM93 precursor RNA, herein designated VGAM PRECURSOR RNA. Similar to other miRNA genes, and unlike most ordinary genes, VGAM93 precursor RNA, herein designated VGAM PRECURSOR RNA, does not encode a protein. A nucleotide sequence identical or highly similar to the nucleotide sequence of VGAM93 precursor RNA is designated SEQ ID:79, and is provided hereinbelow with reference to the sequence listing part. Nucleotide sequence SEQ ID:79 is located at position 32553 relative to the genome of Vaccinia virus.

VGAM93 precursor RNA, herein designated VGAM PRECURSOR RNA, folds onto itself, forming VGAM93 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM93 folded precursor RNA, herein designated VGAM FOLDED PRECURSOR RNA, into VGAM93 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 89%) nucleotide sequence of VGAM93 RNA is designated SEQ ID:428, and is provided hereinbelow with reference to the sequence listing part.

VGAM93 host target gene, herein designated VGAM HOST TARGET GENE, encodes a corresponding messenger RNA, VGAM93 host target RNA, herein designated VGAM HOST TARGET RNA. VGAM93 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM93 RNA, herein designated VGAM RNA, binds complementarily to one or more host target binding sites located in untranslated regions of VGAM93 host target RNA, herein designated VGAM HOST TARGET RNA. This complementary binding is due to the fact that the nucleotide sequence of VGAM93 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM93 RNA, herein designated VGAM RNA, may have a different number of host target binding sites in untranslated regions of a VGAM93 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM93 RNA, herein designated VGAM RNA, to host target binding sites on VGAM93 host target RNA, herein designated VGAM HOST TARGET RNA, such as BINDING SITE I, BINDING SITE II and BINDING SITE III, inhibits translation of VGAM93 host target RNA, herein designated VGAM HOST TARGET RNA, into VGAM93 host target protein, herein designated VGAM HOST TARGET PROTEIN. VGAM host target protein is therefore outlined by a broken line.

It is appreciated that VGAM93 host target gene, herein designated VGAM HOST TARGET GENE, in fact represents a plurality of VGAM93 host target genes. The mRNA of each one of this plurality of VGAM93 host target genes comprises one or more host target binding sites, each having a nucleotide sequence which is at least partly complementary to VGAM93 RNA, herein designated VGAM RNA, and which when bound by VGAM93 RNA, herein designated VGAM RNA, causes inhibition of translation of respective one or more VGAM93 host target proteins.

It is further appreciated by one skilled in the art that the mode of translational inhibition illustrated by FIG. 1 with specific reference to translational inhibition exerted by VGAM93 gene, herein designated VGAM GENE, on one or more VGAM93 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM93 is inhibition of expression of host target genes, as part of a novel viral mechanism of attacking a host. Accordingly, utilities of VGAM93 include diagnosis, prevention and treatment of viral infection by Vaccinia virus. Specific functions, and accordingly utilities, of VGAM93 correlate with, and may be deduced from, the identity of the host target genes which VGAM93 binds and inhibits, and the function of these host target genes, as elaborated hereinbelow.

Nucleotide sequences of the VGAM93 precursor RNA, herein designated VGAM PRECURSOR RNA, and of the diced VGAM93 RNA, herein designated VGAM RNA, and a schematic representation of the secondary folding of VGAM93 folded precursor RNA, herein designated VGAM FOLDED PRECURSOR RNA, of VGAM93 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM93 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 94 (VGAM94) viral gene, which modulates expression of respective host target genes thereof, the function and utility of which host target genes is known in the art.

VGAM94 is a novel bioinformatically detected regulatory, non protein coding, viral micro RNA (miRNA) gene. The method by which VGAM94 was detected is described hereinabove with reference to FIGS. 2-8.

VGAM94 gene, herein designated VGAM GENE, is a viral gene contained in the genome of Vaccinia virus. VGAM94 host target gene, herein designated VGAM HOST TARGET GENE, is a human gene contained in the human genome.

VGAM94 gene, herein designated VGAM GENE, encodes a VGAM94 precursor RNA, herein designated VGAM PRECURSOR RNA. Similar to other miRNA genes, and unlike most ordinary genes, VGAM94 precursor RNA, herein designated VGAM PRECURSOR RNA, does not encode a protein. A nucleotide sequence identical or highly similar to the nucleotide sequence of VGAM94 precursor RNA is designated SEQ ID:80, and is provided hereinbelow with reference to the sequence listing part. Nucleotide sequence SEQ ID:80 is located at position 32481 relative to the genome of Vaccinia virus.

VGAM94 precursor RNA, herein designated VGAM PRECURSOR RNA, folds onto itself, forming VGAM94 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM94 folded precursor RNA, herein designated VGAM FOLDED PRECURSOR RNA, into VGAM94 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM94 RNA is designated SEQ ID:429, and is provided hereinbelow with reference to the sequence listing part.

VGAM94 host target gene, herein designated VGAM HOST TARGET GENE, encodes a corresponding messenger RNA, VGAM94 host target RNA, herein designated VGAM HOST TARGET RNA. VGAM94 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM94 RNA, herein designated VGAM RNA, binds complementarily to one or more host target binding sites located in untranslated regions of VGAM94 host target RNA, herein designated VGAM HOST TARGET RNA. This complementary binding is due to the fact that the nucleotide sequence of VGAM94 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM94 RNA, herein designated VGAM RNA, may have a different number of host target binding sites in untranslated regions of a VGAM94 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM94 RNA, herein designated VGAM RNA, to host target binding sites on VGAM94 host target RNA, herein designated VGAM HOST TARGET RNA, such as BINDING SITE I, BINDING SITE II and BINDING SITE III, inhibits translation of VGAM94 host target RNA, herein designated VGAM HOST TARGET RNA, into VGAM94 host target protein, herein designated VGAM HOST TARGET PROTEIN. VGAM host target protein is therefore outlined by a broken line.

It is appreciated that VGAM94 host target gene, herein designated VGAM HOST TARGET GENE, in fact represents a plurality of VGAM94 host target genes. The mRNA of each one of this plurality of VGAM94 host target genes comprises one or more host target binding sites, each having a nucleotide sequence which is at least partly complementary to VGAM94 RNA, herein designated VGAM RNA, and which when bound by VGAM94 RNA, herein designated VGAM RNA, causes inhibition of translation of respective one or more VGAM94 host target proteins.

It is further appreciated by one skilled in the art that the mode of translational inhibition illustrated by FIG. 1 with specific reference to translational inhibition exerted by VGAM94 gene, herein designated VGAM GENE, on one or more VGAM94 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM94 is inhibition of expression of host target genes, as part of a novel viral mechanism of attacking a host. Accordingly, utilities of VGAM94 include diagnosis, prevention and treatment of viral infection by Vaccinia virus. Specific functions, and accordingly utilities of VGAM94 correlate with, and may be deduced from, the identity of the host target genes which VGAM94 binds and inhibits, and the function of these host target genes, as elaborated hereinbelow.

Nucleotide sequences of the VGAM94 precursor RNA, herein designated VGAM PRECURSOR RNA, and of the diced VGAM94 RNA, herein designated VGAM RNA, and a schematic representation of the secondary folding of VGAM94 folded precursor RNA, herein designated VGAM FOLDED PRECURSOR RNA, of VGAM94 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM94 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 95 (VGAM95) viral gene, which modulates expression of respective host target genes thereof, the function and utility of which host target genes is known in the art.

VGAM95 is a novel bioinformatically detected regulatory, non protein coding, viral micro RNA (miRNA) gene. The method by which VGAM95 was detected is described hereinabove with reference to FIGS. 2-8.

VGAM95 gene, herein designated VGAM GENE, is a viral gene contained in the genome of Vaccinia virus. VGAM95 host target gene, herein designated VGAM HOST TARGET GENE, is a human gene contained in the human genome.

VGAM95 gene, herein designated VGAM GENE, encodes a VGAM95 precursor RNA, herein designated VGAM PRECURSOR RNA. Similar to other miRNA genes, and unlike most ordinary genes, VGAM95 precursor RNA, herein designated VGAM PRECURSOR RNA, does not encode a protein. A nucleotide sequence identical or highly similar to the nucleotide sequence of VGAM95 precursor RNA is designated SEQ ID:81, and is provided hereinbelow with reference to the sequence listing part. Nucleotide sequence SEQ ID:81 is located at position 31304 relative to the genome of Vaccinia virus.

VGAM95 precursor RNA, herein designated VGAM PRECURSOR RNA, folds onto itself, forming VGAM95 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM95 folded precursor RNA, herein designated VGAM FOLDED PRECURSOR RNA, into VGAM95 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM95 RNA is designated SEQ ID:430, and is provided hereinbelow with reference to the sequence listing part.

VGAM95 host target gene, herein designated VGAM HOST TARGET GENE, encodes a corresponding messenger RNA, VGAM95 host target RNA, herein designated VGAM HOST TARGET RNA. VGAM95 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM95 RNA, herein designated VGAM RNA, binds complementarily to one or more host target binding sites located in untranslated regions of VGAM95 host target RNA, herein designated VGAM HOST TARGET RNA. This complementary binding is due to the fact that the nucleotide sequence of VGAM95 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM95 RNA, herein designated VGAM RNA, may have a different number of host target binding sites in untranslated regions of a VGAM95 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM95 RNA, herein designated VGAM RNA, to host target binding sites on VGAM95 host target RNA, herein designated VGAM HOST TARGET RNA, such as BINDING SITE I, BINDING SITE II and BINDING SITE III, inhibits translation of VGAM95 host target RNA, herein designated VGAM HOST TARGET RNA, into VGAM95 host target protein, herein designated VGAM HOST TARGET PROTEIN. VGAM host target protein is therefore outlined by a broken line.

It is appreciated that VGAM95 host target gene, herein designated VGAM HOST TARGET GENE, in fact represents a plurality of VGAM95 host target genes. The mRNA of each one of this plurality of VGAM95 host target genes comprises one or more host target binding sites, each having a nucleotide sequence which is at least partly complementary to VGAM95 RNA, herein designated VGAM RNA, and which when bound by VGAM95 RNA, herein designated VGAM RNA, causes inhibition of translation of respective one or more VGAM95 host target proteins.

It is further appreciated by one skilled in the art that the mode of translational inhibition illustrated by FIG. 1 with specific reference to translational inhibition exerted by VGAM95 gene, herein designated VGAM GENE, on one or more VGAM95 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM95 is inhibition of expression of host target genes, as part of a novel viral mechanism of attacking a host. Accordingly, utilities of VGAM95 include diagnosis, prevention and treatment of viral infection by Vaccinia virus. Specific functions, and accordingly utilities, of VGAM95 correlate with, and may be deduced from, the identity of the host target genes which VGAM95 binds and inhibits, and the function of these host target genes, as elaborated hereinbelow.

Nucleotide sequences of the VGAM95 precursor RNA, herein designated VGAM PRECURSOR RNA, and of the diced VGAM95 RNA, herein designated VGAM RNA, and a schematic representation of the secondary folding of VGAM95 folded precursor RNA, herein designated VGAM FOLDED PRECURSOR RNA, of VGAM95 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM95 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 96 (VGAM96) viral gene, which modulates expression of respective host target genes thereof, the function and utility of which host target genes is known in the art.

VGAM96 is a novel bioinformatically detected regulatory, non protein coding, viral micro RNA (miRNA) gene. The method by which VGAM96 was detected is described hereinabove with reference to FIGS. 2-8.

VGAM96 gene, herein designated VGAM GENE, is a viral gene contained in the genome of Vaccinia virus. VGAM96 host target gene, herein designated VGAM HOST TARGET GENE, is a human gene contained in the human genome.

VGAM96 gene, herein designated VGAM GENE, encodes a VGAM96 precursor RNA, herein designated VGAM PRECURSOR RNA. Similar to other miRNA genes, and unlike most ordinary genes, VGAM96 precursor RNA, herein designated VGAM PRECURSOR RNA, does not encode a protein. A nucleotide sequence identical or highly similar to the nucleotide sequence of VGAM96 precursor RNA is designated SEQ ID:82, and is provided hereinbelow with reference to the sequence listing part. Nucleotide sequence SEQ ID:82 is located at position 30764 relative to the genome of Vaccinia virus.

VGAM96 precursor RNA, herein designated VGAM PRECURSOR RNA, folds onto itself, forming VGAM96 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM96 folded precursor RNA, herein designated VGAM FOLDED PRECURSOR RNA, into VGAM96 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 90%) nucleotide sequence of VGAM96 RNA is designated SEQ ID:431, and is provided hereinbelow with reference to the sequence listing part.

VGAM96 host target gene, herein designated VGAM HOST TARGET GENE, encodes a corresponding messenger RNA, VGAM96 host target RNA, herein designated VGAM HOST TARGET RNA. VGAM96 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM96 RNA, herein designated VGAM RNA, binds complementarily to one or more host target binding sites located in untranslated regions of VGAM96 host target RNA, herein designated VGAM HOST TARGET RNA. This complementary binding is due to the fact that the nucleotide sequence of VGAM96 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM96 RNA, herein designated VGAM RNA, may have a different number of host target binding sites in untranslated regions of a VGAM96 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM96 RNA, herein designated VGAM RNA, to host target binding sites on VGAM96 host target RNA, herein designated VGAM HOST TARGET RNA, such as BINDING SITE I, BINDING SITE II and BINDING SITE III, inhibits translation of VGAM96 host target RNA, herein designated VGAM HOST TARGET RNA, into VGAM96 host target protein, herein designated VGAM HOST TARGET PROTEIN. VGAM host target protein is therefore outlined by a broken line.

It is appreciated that VGAM96 host target gene, herein designated VGAM HOST TARGET GENE, in fact represents a plurality of VGAM96 host target genes. The mRNA of each one of this plurality of VGAM96 host target genes comprises one or more host target binding sites, each having a nucleotide sequence which is at least partly complementary to VGAM96 RNA, herein designated VGAM RNA, and which when bound by VGAM96 RNA, herein designated VGAM RNA, causes inhibition of translation of respective one or more VGAM96 host target proteins.

It is further appreciated by one skilled in the art that the mode of translational inhibition illustrated by FIG. 1 with specific reference to translational inhibition exerted by VGAM96 gene, herein designated VGAM GENE, on one or more VGAM96 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM96 is inhibition of expression of host target genes, as part of a novel viral mechanism of attacking a host. Accordingly, utilities of VGAM96 include diagnosis, prevention and treatment of viral infection by Vaccinia virus. Specific functions, and accordingly utilities, of VGAM96 correlate with, and may be deduced from, the identity of the host target genes which VGAM96 binds and inhibits, and the function of these host target genes, as elaborated hereinbelow.

Nucleotide sequences of the VGAM96 precursor RNA, herein designated VGAM PRECURSOR RNA, and of the diced VGAM96 RNA, herein designated VGAM RNA, and a schematic representation of the secondary folding of VGAM96 folded precursor RNA, herein designated VGAM FOLDED PRECURSOR RNA, of VGAM96 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM96 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 97 (VGAM97) viral gene, which modulates expression of respective host target genes thereof, the function and utility of which host target genes is known in the art.

VGAM97 is a novel bioinformatically detected regulatory, non protein coding, viral micro RNA (miRNA) gene. The method by which VGAM97 was detected is described hereinabove with reference to FIGS. 2-8.

VGAM97 gene, herein designated VGAM GENE, is a viral gene contained in the genome of Vaccinia virus. VGAM97 host target gene, herein designated VGAM HOST TARGET GENE, is a human gene contained in the human genome.

VGAM97 gene, herein designated VGAM GENE, encodes a VGAM97 precursor RNA, herein designated VGAM PRECURSOR RNA. Similar to other miRNA genes, and unlike most ordinary genes, VGAM97 precursor RNA, herein designated VGAM PRECURSOR RNA, does not encode a protein. A nucleotide sequence identical or highly similar to the nucleotide sequence of VGAM97 precursor RNA is designated SEQ ID:83, and is provided hereinbelow with reference to the sequence listing part. Nucleotide sequence SEQ ID:83 is located at position 31794 relative to the genome of Vaccinia virus.

VGAM97 precursor RNA, herein designated VGAM PRECURSOR RNA, folds onto itself, forming VGAM97 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM97 folded precursor RNA, herein designated VGAM FOLDED PRECURSOR RNA, into VGAM97 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM97 RNA is designated SEQ ID:432, and is provided hereinbelow with reference to the sequence listing part.

VGAM97 host target gene, herein designated VGAM HOST TARGET GENE, encodes a corresponding messenger RNA, VGAM97 host target RNA, herein designated VGAM HOST TARGET RNA. VGAM97 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM97 RNA, herein designated VGAM RNA, binds complementarily to one or more host target binding sites located in untranslated regions of VGAM97 host target RNA, herein designated VGAM HOST TARGET RNA. This complementary binding is due to the fact that the nucleotide sequence of VGAM97 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM97 RNA, herein designated VGAM RNA, may have a different number of host target binding sites in untranslated regions of a VGAM97 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM97 RNA, herein designated VGAM RNA, to host target binding sites on VGAM97 host target RNA, herein designated VGAM HOST TARGET RNA, such as BINDING SITE I, BINDING SITE II and BINDING SITE III, inhibits translation of VGAM97 host target RNA, herein designated VGAM HOST TARGET RNA, into VGAM97 host target protein, herein designated VGAM HOST TARGET PROTEIN. VGAM host target protein is therefore outlined by a broken line.

It is appreciated that VGAM97 host target gene, herein designated VGAM HOST TARGET GENE, in fact represents a plurality of VGAM97 host target genes. The mRNA of each one of this plurality of VGAM97 host target genes comprises one or more host target binding sites, each having a nucleotide sequence which is at least partly complementary to VGAM97 RNA, herein designated VGAM RNA, and which when bound by VGAM97 RNA, herein designated VGAM RNA, causes inhibition of translation of respective one or more VGAM97 host target proteins.

It is further appreciated by one skilled in the art that the mode of translational inhibition illustrated by FIG. 1 with specific reference to translational inhibition exerted by VGAM97 gene, herein designated VGAM GENE, on one or more VGAM97 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM97 is inhibition of expression of host target genes, as part of a novel viral mechanism of attacking a host. Accordingly, utilities of VGAM97 include diagnosis, prevention and treatment of viral infection by Vaccinia virus. Specific functions, and accordingly utilities, of VGAM97 correlate with, and may be deduced from, the identity of the host target genes which VGAM97 binds and inhibits, and the function of these host target genes, as elaborated hereinbelow.

Nucleotide sequences of the VGAM97 precursor RNA, herein designated VGAM PRECURSOR RNA, and of the diced VGAM97 RNA, herein designated VGAM RNA, and a schematic representation of the secondary folding of VGAM97 folded precursor RNA, herein designated VGAM FOLDED PRECURSOR RNA, of VGAM97 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM97 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 98 (VGAM98) viral gene, which modulates expression of respective host target genes thereof, the function and utility of which host target genes is known in the art.

VGAM98 is a novel bioinformatically detected regulatory, non protein coding, viral micro RNA (miRNA) gene. The method by which VGAM98 was detected is described hereinabove with reference to FIGS. 2-8.

VGAM98 gene, herein designated VGAM GENE, is a viral gene contained in the genome of Vaccinia virus. VGAM98 host target gene, herein designated VGAM HOST TARGET GENE, is a human gene contained in the human genome.

VGAM98 gene, herein designated VGAM GENE, encodes a VGAM98 precursor RNA, herein designated VGAM PRECURSOR RNA. Similar to other miRNA genes, and unlike most ordinary genes, VGAM98 precursor RNA, herein designated VGAM PRECURSOR RNA, does not encode a protein. A nucleotide sequence identical or highly similar to the nucleotide sequence of VGAM98 precursor RNA is designated SEQ ID:84, and is provided hereinbelow with reference to the sequence listing part. Nucleotide sequence SEQ ID:84 is located at position 34330 relative to the genome of Vaccinia virus.

VGAM98 precursor RNA, herein designated VGAM PRECURSOR RNA, folds onto itself, forming VGAM98 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM98 folded precursor RNA, herein designated VGAM FOLDED PRECURSOR RNA, into VGAM98 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 72%) nucleotide sequence of VGAM98 RNA is designated SEQ ID:433, and is provided hereinbelow with reference to the sequence listing part.

VGAM98 host target gene, herein designated VGAM HOST TARGET GENE, encodes a corresponding messenger RNA, VGAM98 host target RNA, herein designated VGAM HOST TARGET RNA. VGAM98 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM98 RNA, herein designated VGAM RNA, binds complementarily to one or more host target binding sites located in untranslated regions of VGAM98 host target RNA, herein designated VGAM HOST TARGET RNA. This complementary binding is due to the fact that the nucleotide sequence of VGAM98 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM98 RNA, herein designated VGAM RNA, may have a different number of host target binding sites in untranslated regions of a VGAM98 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM98 RNA, herein designated VGAM RNA, to host target binding sites on VGAM98 host target RNA, herein designated VGAM HOST TARGET RNA, such as BINDING SITE I, BINDING SITE II and BINDING SITE III, inhibits translation of VGAM98 host target RNA, herein designated VGAM HOST TARGET RNA, into VGAM98 host target protein, herein designated VGAM HOST TARGET PROTEIN. VGAM host target protein is therefore outlined by a broken line.

It is appreciated that VGAM98 host target gene, herein designated VGAM HOST TARGET GENE, in fact represents a plurality of VGAM98 host target genes. The mRNA of each one of this plurality of VGAM98 host target genes comprises one or more host target binding sites, each having a nucleotide sequence which is at least partly complementary to VGAM98 RNA, herein designated VGAM RNA, and which when bound by VGAM98 RNA, herein designated VGAM RNA, causes inhibition of translation of respective one or more VGAM98 host target proteins.

It is further appreciated by one skilled in the art that the mode of translational inhibition illustrated by FIG. 1 with specific reference to translational inhibition exerted by VGAM98 gene, herein designated VGAM GENE, on one or more VGAM98 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM98 is inhibition of expression of host target genes, as part of a novel viral mechanism of attacking a host. Accordingly, utilities of VGAM98 include diagnosis, prevention and treatment of viral infection by Vaccinia virus. Specific functions, and accordingly utilities, of VGAM98 correlate with, and may be deduced from, the identity of the host target genes which VGAM98 binds and inhibits, and the function of these host target genes, as elaborated hereinbelow.

Nucleotide sequences of the VGAM98 precursor RNA, herein designated VGAM PRECURSOR RNA, and of the diced VGAM98 RNA, herein designated VGAM RNA, and a schematic representation of the secondary folding of VGAM98 folded precursor RNA, herein designated VGAM FOLDED PRECURSOR RNA, of VGAM98 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM98 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 99 (VGAM99) viral gene, which modulates expression of respective host target genes thereof, the function and utility of which host target genes is known in the art.

VGAM99 is a novel bioinformatically detected regulatory, non protein coding, viral micro RNA (miRNA) gene. The method by which VGAM99 was detected is described hereinabove with reference to FIGS. 2-8.

VGAM99 gene, herein designated VGAM GENE, is a viral gene contained in the genome of Vaccinia virus. VGAM99 host target gene, herein designated VGAM HOST TARGET GENE, is a human gene contained in the human genome.

VGAM99 gene, herein designated VGAM GENE, encodes a VGAM99 precursor RNA, herein designated VGAM PRECURSOR RNA. Similar to other miRNA genes, and unlike most ordinary genes, VGAM99 precursor RNA, herein designated VGAM PRECURSOR RNA, does not encode a protein. A nucleotide sequence identical or highly similar to the nucleotide sequence of VGAM99 precursor RNA is designated SEQ ID:85, and is provided hereinbelow with reference to the sequence listing part. Nucleotide sequence SEQ ID:85 is located at position 39758 relative to the genome of Vaccinia virus.

VGAM99 precursor RNA, herein designated VGAM PRECURSOR RNA, folds onto itself, forming VGAM99 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM99 folded precursor RNA, herein designated VGAM FOLDED PRECURSOR RNA, into VGAM99 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM99 RNA is designated SEQ ID:434, and is provided hereinbelow with reference to the sequence listing part.

VGAM99 host target gene, herein designated VGAM HOST TARGET GENE, encodes a corresponding messenger RNA, VGAM99 host target RNA, herein designated VGAM HOST TARGET RNA. VGAM99 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM99 RNA, herein designated VGAM RNA, binds complementarily to one or more host target binding sites located in untranslated regions of VGAM99 host target RNA, herein designated VGAM HOST TARGET RNA. This complementary binding is due to the fact that the nucleotide sequence of VGAM99 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM99 RNA, herein designated VGAM RNA, may have a different number of host target binding sites in untranslated regions of a VGAM99 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM99 RNA, herein designated VGAM RNA, to host target binding sites on VGAM99 host target RNA, herein designated VGAM HOST TARGET RNA, such as BINDING SITE I, BINDING SITE II and BINDING SITE III, inhibits translation of VGAM99 host target RNA, herein designated VGAM HOST TARGET RNA, into VGAM99 host target protein, herein designated VGAM HOST TARGET PROTEIN. VGAM host target protein is therefore outlined by a broken line.

It is appreciated that VGAM99 host target gene, herein designated VGAM HOST TARGET GENE, in fact represents a plurality of VGAM99 host target genes. The mRNA of each one of this plurality of VGAM99 host target genes comprises one or more host target binding sites, each having a nucleotide sequence which is at least partly complementary to VGAM99 RNA, herein designated VGAM RNA, and which when bound by VGAM99 RNA, herein designated VGAM RNA, causes inhibition of translation of respective one or more VGAM99 host target proteins.

It is further appreciated by one skilled in the art that the mode of translational inhibition illustrated by FIG. 1 with specific reference to translational inhibition exerted by VGAM99 gene, herein designated VGAM GENE, on one or more VGAM99 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM99 is inhibition of expression of host target genes, as part of a novel viral mechanism of attacking a host. Accordingly, utilities of VGAM99 include diagnosis, prevention and treatment of viral infection by Vaccinia virus. Specific functions, and accordingly utilities, of VGAM99 correlate with, and may be deduced from, the identity of the host target genes which VGAM99 binds and inhibits, and the function of these host target genes, as elaborated hereinbelow.

Nucleotide sequences of the VGAM99 precursor RNA, herein designated VGAM PRECURSOR RNA, and of the diced VGAM99 RNA, herein designated VGAM RNA, and a schematic representation of the secondary folding of VGAM99 folded precursor RNA, herein designated VGAM FOLDED PRECURSOR RNA, of VGAM99 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM99 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 100 (VGAM100) viral gene, which modulates expression of respective host target genes thereof, the function and utility of which host target genes is known in the art.

VGAM100 is a novel bioinformatically detected regulatory, non protein coding, viral micro RNA (miRNA) gene. The method by which VGAM100 was detected is described hereinabove with reference to FIGS. 2-8.

VGAM100 gene, herein designated VGAM GENE, is a viral gene contained in the genome of Vaccinia virus. VGAM100 host target gene, herein designated VGAM HOST TARGET GENE, is a human gene contained in the human genome.

VGAM100 gene, herein designated VGAM GENE, encodes a VGAM100 precursor RNA, herein designated VGAM PRECURSOR RNA. Similar to other miRNA genes, and unlike most ordinary genes, VGAM100 precursor RNA, herein designated VGAM PRECURSOR RNA, does not encode a protein. A nucleotide sequence identical or highly similar to the nucleotide sequence of VGAM100 precursor RNA is designated SEQ ID:86, and is provided hereinbelow with reference to the sequence listing part. Nucleotide sequence SEQ ID:86 is located at position 36878 relative to the genome of Vaccinia virus.

VGAM100 precursor RNA, herein designated VGAM PRECURSOR RNA, folds onto itself, forming VGAM100 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM100 folded precursor RNA, herein designated VGAM FOLDED PRECURSOR RNA, into VGAM100 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM100 RNA is designated SEQ ID:435, and is provided hereinbelow with reference to the sequence listing part.

VGAM100 host target gene, herein designated VGAM HOST TARGET GENE, encodes a corresponding messenger RNA, VGAM100 host target RNA, herein designated VGAM HOST TARGET RNA. VGAM100 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM100 RNA, herein designated VGAM RNA, binds complementarily to one or more host target binding sites located in untranslated regions of VGAM100 host target RNA, herein designated VGAM HOST TARGET RNA. This complementary binding is due to the fact that the nucleotide sequence of VGAM100 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM100 RNA, herein designated VGAM RNA, may have a different number of host target binding sites in untranslated regions of a VGAM100 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM100 RNA, herein designated VGAM RNA, to host target binding sites on VGAM100 host target RNA, herein designated VGAM HOST TARGET RNA, such as BINDING SITE I, BINDING SITE II and BINDING SITE III, inhibits translation of VGAM100 host target RNA, herein designated VGAM HOST TARGET RNA, into VGAM100 host target protein, herein designated VGAM HOST TARGET PROTEIN. VGAM host target protein is therefore outlined by a broken line.

It is appreciated that VGAM100 host target gene, herein designated VGAM HOST TARGET GENE, in fact represents a plurality of VGAM100 host target genes. The mRNA of each one of this plurality of VGAM100 host target genes comprises one or more host target binding sites, each having a nucleotide sequence which is at least partly complementary to VGAM100 RNA, herein designated VGAM RNA, and which when bound by VGAM100 RNA, herein designated VGAM RNA, causes inhibition of translation of respective one or more VGAM100 host target proteins.

It is further appreciated by one skilled in the art that the mode of translational inhibition illustrated by FIG. 1 with specific reference to translational inhibition exerted by VGAM100 gene, herein designated VGAM GENE, on one or more VGAM100 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM100 is inhibition of expression of host target genes, as part of a novel viral mechanism of attacking a host. Accordingly, utilities of VGAM100 include diagnosis, prevention and treatment of viral infection by Vaccinia virus. Specific functions, and accordingly utilities, of VGAM100 correlate with, and may be deduced from, the identity of the host target genes which VGAM100 binds and inhibits, and the function of these host target genes, as elaborated hereinbelow.

Nucleotide sequences of the VGAM100 precursor RNA, herein designated VGAM PRECURSOR RNA, and of the diced VGAM100 RNA, herein designated VGAM RNA, and a schematic representation of the secondary folding of VGAM100 folded precursor RNA, herein designated VGAM FOLDED PRECURSOR RNA, of VGAM100 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM100 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 101 (VGAM101) viral gene, which modulates expression of respective host target genes thereof, the function and utility of which host target genes is known in the art.

VGAM101 is a novel bioinformatically detected regulatory, non protein coding, viral micro RNA (miRNA) gene. The method by which VGAM101 was detected is described hereinabove with reference to FIGS. 2-8.

VGAM101 gene, herein designated VGAM GENE, is a viral gene contained in the genome of Vaccinia virus. VGAM101 host target gene, herein designated VGAM HOST TARGET GENE, is a human gene contained in the human genome.

VGAM101 gene, herein designated VGAM GENE, encodes a VGAM101 precursor RNA, herein designated VGAM PRECURSOR RNA. Similar to other miRNA genes, and unlike most ordinary genes, VGAM101 precursor RNA, herein designated VGAM PRECURSOR RNA, does not encode a protein. A nucleotide sequence identical or highly similar to the nucleotide sequence of VGAM101 precursor RNA is designated SEQ ID:87, and is provided hereinbelow with reference to the sequence listing part. Nucleotide sequence SEQ ID:87 is located at position 41548 relative to the genome of Vaccinia virus.

VGAM101 precursor RNA, herein designated VGAM PRECURSOR RNA, folds onto itself, forming VGAM101 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM101 folded precursor RNA, herein designated VGAM FOLDED PRECURSOR RNA, into VGAM101 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM101 RNA is designated SEQ ID:436, and is provided hereinbelow with reference to the sequence listing part.

VGAM101 host target gene, herein designated VGAM HOST TARGET GENE, encodes a corresponding messenger RNA, VGAM101 host target RNA, herein designated VGAM HOST TARGET RNA. VGAM101 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM101 RNA, herein designated VGAM RNA, binds complementarily to one or more host target binding sites located in untranslated regions of VGAM101 host target RNA, herein designated VGAM HOST TARGET RNA. This complementary binding is due to the fact that the nucleotide sequence of VGAM101 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM101 RNA, herein designated VGAM RNA, may have a different number of host target binding sites in untranslated regions of a VGAM101 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM101 RNA, herein designated VGAM RNA, to host target binding sites on VGAM101 host target RNA, herein designated VGAM HOST TARGET RNA, such as BINDING SITE I, BINDING SITE II and BINDING SITE III, inhibits translation of VGAM101 host target RNA, herein designated VGAM HOST TARGET RNA, into VGAM101 host target protein, herein designated VGAM HOST TARGET PROTEIN. VGAM host target protein is therefore outlined by a broken line.

It is appreciated that VGAM101 host target gene, herein designated VGAM HOST TARGET GENE, in fact represents a plurality of VGAM101 host target genes. The mRNA of each one of this plurality of VGAM101 host target genes comprises one or more host target binding sites, each having a nucleotide sequence which is at least partly complementary to VGAM101 RNA, herein designated VGAM RNA, and which when bound by VGAM101 RNA, herein designated VGAM RNA, causes inhibition of translation of respective one or more VGAM101 host target proteins.

It is further appreciated by one skilled in the art that the mode of translational inhibition illustrated by FIG. 1 with specific reference to translational inhibition exerted by VGAM101 gene, herein designated VGAM GENE, on one or more VGAM101 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM101 is inhibition of expression of host target genes, as part of a novel viral mechanism of attacking a host. Accordingly, utilities of VGAM101 include diagnosis, prevention and treatment of viral infection by Vaccinia virus. Specific functions, and accordingly utilities, of VGAM101 correlate with, and may be deduced from, the identity of the host target genes which VGAM101 binds and inhibits, and the function of these host target genes, as elaborated hereinbelow.

Nucleotide sequences of the VGAM101 precursor RNA, herein designated VGAM PRECURSOR RNA, and of the diced VGAM101 RNA, herein designated VGAM RNA, and a schematic representation of the secondary folding of VGAM101 folded precursor RNA, herein designated VGAM FOLDED PRECURSOR RNA, of VGAM101 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM101 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 102 (VGAM102) viral gene, which modulates expression of respective host target genes thereof, the function and utility of which host target genes is known in the art.

VGAM102 is a novel bioinformatically detected regulatory, non protein coding, viral micro RNA (miRNA) gene. The method by which VGAM102 was detected is described hereinabove with reference to FIGS. 2-8.

VGAM102 gene, herein designated VGAM GENE, is a viral gene contained in the genome of Vaccinia virus. VGAM102 host target gene, herein designated VGAM HOST TARGET GENE, is a human gene contained in the human genome.

VGAM102 gene, herein designated VGAM GENE, encodes a VGAM102 precursor RNA, herein designated VGAM PRECURSOR RNA. Similar to other miRNA genes, and unlike most ordinary genes, VGAM102 precursor RNA, herein designated VGAM PRECURSOR RNA, does not encode a protein. A nucleotide sequence identical or highly similar to the nucleotide sequence of VGAM102 precursor RNA is designated SEQ ID:88, and is provided hereinbelow with reference to the sequence listing part. Nucleotide sequence SEQ ID:88 is located at position 41122 relative to the genome of Vaccinia virus.

VGAM102 precursor RNA, herein designated VGAM PRECURSOR RNA, folds onto itself, forming VGAM102 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM102 folded precursor RNA, herein designated VGAM FOLDED PRECURSOR RNA, into VGAM102 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM102 RNA is designated SEQ ID:437, and is provided hereinbelow with reference to the sequence listing part.

VGAM102 host target gene, herein designated VGAM HOST TARGET GENE, encodes a corresponding messenger RNA, VGAM102 host target RNA, herein designated VGAM HOST TARGET RNA. VGAM102 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM102 RNA, herein designated VGAM RNA, binds complementarily to one or more host target binding sites located in untranslated regions of VGAM102 host target RNA, herein designated VGAM HOST TARGET RNA. This complementary binding is due to the fact that the nucleotide sequence of VGAM102 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM102 RNA, herein designated VGAM RNA, may have a different number of host target binding sites in untranslated regions of a VGAM102 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM102 RNA, herein designated VGAM RNA, to host target binding sites on VGAM102 host target RNA, herein designated VGAM HOST TARGET RNA, such as BINDING SITE I, BINDING SITE II and BINDING SITE III, inhibits translation of VGAM102 host target RNA, herein designated VGAM HOST TARGET RNA, into VGAM102 host target protein, herein designated VGAM HOST TARGET PROTEIN. VGAM host target protein is therefore outlined by a broken line.

It is appreciated that VGAM102 host target gene, herein designated VGAM HOST TARGET GENE, in fact represents a plurality of VGAM102 host target genes. The mRNA of each one of this plurality of VGAM102 host target genes comprises one or more host target binding sites, each having a nucleotide sequence which is at least partly complementary to VGAM102 RNA, herein designated VGAM RNA, and which when bound by VGAM102 RNA, herein designated VGAM RNA, causes inhibition of translation of respective one or more VGAM102 host target proteins.

It is further appreciated by one skilled in the art that the mode of translational inhibition illustrated by FIG. 1 with specific reference to translational inhibition exerted by VGAM102 gene, herein designated VGAM GENE, on one or more VGAM102 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM102 is inhibition of expression of host target genes, as part of a novel viral mechanism of attacking a host. Accordingly, utilities of VGAM102 include diagnosis, prevention and treatment of viral infection by Vaccinia virus. Specific functions, and accordingly utilities, of VGAM102 correlate with, and may be deduced from, the identity of the host target genes which VGAM102 binds and inhibits, and the function of these host target genes, as elaborated hereinbelow.

Nucleotide sequences of the VGAM102 precursor RNA, herein designated VGAM PRECURSOR RNA, and of the diced VGAM102 RNA, herein designated VGAM RNA, and a schematic representation of the secondary folding of VGAM102 folded precursor RNA, herein designated VGAM FOLDED PRECURSOR RNA, of VGAM102 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM102 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 103 (VGAM103) viral gene, which modulates expression of respective host target genes thereof, the function and utility of which host target genes is known in the art.

VGAM103 is a novel bioinformatically detected regulatory, non protein coding, viral micro RNA (miRNA) gene. The method by which VGAM103 was detected is described hereinabove with reference to FIGS. 2-8.

VGAM103 gene, herein designated VGAM GENE, is a viral gene contained in the genome of Vaccinia virus. VGAM103 host target gene, herein designated VGAM HOST TARGET GENE, is a human gene contained in the human genome.

VGAM103 gene, herein designated VGAM GENE, encodes a VGAM103 precursor RNA, herein designated VGAM PRECURSOR RNA. Similar to other miRNA genes, and unlike most ordinary genes, VGAM103 precursor RNA, herein designated VGAM PRECURSOR RNA, does not encode a protein. A nucleotide sequence identical or highly similar to the nucleotide sequence of VGAM103 precursor RNA is designated SEQ ID:89, and is provided hereinbelow with reference to the sequence listing part. Nucleotide sequence SEQ ID:89 is located at position 42559 relative to the genome of Vaccinia virus.

VGAM103 precursor RNA, herein designated VGAM PRECURSOR RNA, folds onto itself, forming VGAM103 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM103 folded precursor RNA, herein designated VGAM FOLDED PRECURSOR RNA, into VGAM103 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 74%) nucleotide sequence of VGAM103 RNA is designated SEQ ID:438, and is provided hereinbelow with reference to the sequence listing part.

VGAM103 host target gene, herein designated VGAM HOST TARGET GENE, encodes a corresponding messenger RNA, VGAM103 host target RNA, herein designated VGAM HOST TARGET RNA. VGAM103 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM103 RNA, herein designated VGAM RNA, binds complementarily to one or more host target binding sites located in untranslated regions of VGAM103 host target RNA, herein designated VGAM HOST TARGET RNA. This complementary binding is due to the fact that the nucleotide sequence of VGAM103 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM103 RNA, herein designated VGAM RNA, may have a different number of host target binding sites in untranslated regions of a VGAM103 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM103 RNA, herein designated VGAM RNA, to host target binding sites on VGAM103 host target RNA, herein designated VGAM HOST TARGET RNA, such as BINDING SITE I, BINDING SITE II and BINDING SITE III, inhibits translation of VGAM103 host target RNA, herein designated VGAM HOST TARGET RNA, into VGAM103 host target protein, herein designated VGAM HOST TARGET PROTEIN. VGAM host target protein is therefore outlined by a broken line.

It is appreciated that VGAM103 host target gene, herein designated VGAM HOST TARGET GENE, in fact represents a plurality of VGAM103 host target genes. The mRNA of each one of this plurality of VGAM103 host target genes comprises one or more host target binding sites, each having a nucleotide sequence which is at least partly complementary to VGAM103 RNA, herein designated VGAM RNA, and which when bound by VGAM103 RNA, herein designated VGAM RNA, causes inhibition of translation of respective one or more VGAM103 host target proteins.

It is further appreciated by one skilled in the art that the mode of translational inhibition illustrated by FIG. 1 with specific reference to translational inhibition exerted by VGAM103 gene, herein designated VGAM GENE, on one or more VGAM103 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM103 is inhibition of expression of host target genes, as part of a novel viral mechanism of attacking a host. Accordingly, utilities of VGAM103 include diagnosis, prevention and treatment of viral infection by Vaccinia virus. Specific functions, and accordingly utilities, of VGAM103 correlate with, and may be deduced from, the identity of the host target genes which VGAM103 binds and inhibits, and the function of these host target genes, as elaborated hereinbelow.

Nucleotide sequences of the VGAM103 precursor RNA, herein designated VGAM PRECURSOR RNA, and of the diced VGAM103 RNA, herein designated VGAM RNA, and a schematic representation of the secondary folding of VGAM103 folded precursor RNA, herein designated VGAM FOLDED PRECURSOR RNA, of VGAM103 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM103 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 104 (VGAM104) viral gene, which modulates expression of respective host target genes thereof, the function and utility of which host target genes is known in the art.

VGAM104 is a novel bioinformatically detected regulatory, non protein coding, viral micro RNA (miRNA) gene. The method by which VGAM104 was detected is described hereinabove with reference to FIGS. 2-8.

VGAM104 gene, herein designated VGAM GENE, is a viral gene contained in the genome of Vaccinia virus. VGAM104 host target gene, herein designated VGAM HOST TARGET GENE, is a human gene contained in the human genome.

VGAM104 gene, herein designated VGAM GENE, encodes a VGAM104 precursor RNA, herein designated VGAM PRECURSOR RNA. Similar to other miRNA genes, and unlike most ordinary genes, VGAM104 precursor RNA, herein designated VGAM PRECURSOR RNA, does not encode a protein. A nucleotide sequence identical or highly similar to the nucleotide sequence of VGAM104 precursor RNA is designated SEQ ID:90, and is provided hereinbelow with reference to the sequence listing part. Nucleotide sequence SEQ ID:90 is located at position 44309 relative to the genome of Vaccinia virus.

VGAM104 precursor RNA, herein designated VGAM PRECURSOR RNA, folds onto itself, forming VGAM104 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM104 folded precursor RNA, herein designated VGAM FOLDED PRECURSOR RNA, into VGAM104 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 79%) nucleotide sequence of VGAM104 RNA is designated SEQ ID:439, and is provided hereinbelow with reference to the sequence listing part.

VGAM104 host target gene, herein designated VGAM HOST TARGET GENE, encodes a corresponding messenger RNA, VGAM104 host target RNA, herein designated VGAM HOST TARGET RNA. VGAM104 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM104 RNA, herein designated VGAM RNA, binds complementarily to one or more host target binding sites located in untranslated regions of VGAM104 host target RNA, herein designated VGAM HOST TARGET RNA. This complementary binding is due to the fact that the nucleotide sequence of VGAM104 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM104 RNA, herein designated VGAM RNA, may have a different number of host target binding sites in untranslated regions of a VGAM104 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM104 RNA, herein designated VGAM RNA, to host target binding sites on VGAM104 host target RNA, herein designated VGAM HOST TARGET RNA, such as BINDING SITE I, BINDING SITE II and BINDING SITE III, inhibits translation of VGAM104 host target RNA, herein designated VGAM HOST TARGET RNA, into VGAM104 host target protein, herein designated VGAM HOST TARGET PROTEIN. VGAM host target protein is therefore outlined by a broken line.

It is appreciated that VGAM104 host target gene, herein designated VGAM HOST TARGET GENE, in fact represents a plurality of VGAM104 host target genes. The mRNA of each one of this plurality of VGAM104 host target genes comprises one or more host target binding sites, each having a nucleotide sequence which is at least partly complementary to VGAM104 RNA, herein designated VGAM RNA, and which when bound by VGAM104 RNA, herein designated VGAM RNA, causes inhibition of translation of respective one or more VGAM104 host target proteins.

It is further appreciated by one skilled in the art that the mode of translational inhibition illustrated by FIG. 1 with specific reference to translational inhibition exerted by VGAM104 gene, herein designated VGAM GENE, on one or more VGAM104 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM104 is inhibition of expression of host target genes, as part of a novel viral mechanism of attacking a host. Accordingly, utilities of VGAM104 include diagnosis, prevention and treatment of viral infection by Vaccinia virus. Specific functions, and accordingly utilities, of VGAM104 correlate with, and may be deduced from, the identity of the host target genes which VGAM104 binds and inhibits, and the function of these host target genes, as elaborated hereinbelow.

Nucleotide sequences of the VGAM104 precursor RNA, herein designated VGAM PRECURSOR RNA, and of the diced VGAM104 RNA, herein designated VGAM RNA, and a schematic representation of the secondary folding of VGAM104 folded precursor RNA, herein designated VGAM FOLDED PRECURSOR RNA, of VGAM104 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM104 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 105 (VGAM105) viral gene, which modulates expression of respective host target genes thereof, the function and utility of which host target genes is known in the art.

VGAM105 is a novel bioinformatically detected regulatory, non protein coding, viral micro RNA (miRNA) gene. The method by which VGAM105 was detected is described hereinabove with reference to FIGS. 2-8.

VGAM105 gene, herein designated VGAM GENE, is a viral gene contained in the genome of Vaccinia virus. VGAM105 host target gene, herein designated VGAM HOST TARGET GENE, is a human gene contained in the human genome.

VGAM105 gene, herein designated VGAM GENE, encodes a VGAM105 precursor RNA, herein designated VGAM PRECURSOR RNA. Similar to other miRNA genes, and unlike most ordinary genes, VGAM105 precursor RNA, herein designated VGAM PRECURSOR RNA, does not encode a protein. A nucleotide sequence identical or highly similar to the nucleotide sequence of VGAM105 precursor RNA is designated SEQ ID:91, and is provided hereinbelow with reference to the sequence listing part. Nucleotide sequence SEQ ID:91 is located at position 44202 relative to the genome of Vaccinia virus.

VGAM105 precursor RNA, herein designated VGAM PRECURSOR RNA, folds onto itself, forming VGAM105 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM105 folded precursor RNA, herein designated VGAM FOLDED PRECURSOR RNA, into VGAM105 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 70%) nucleotide sequence of VGAM105 RNA is designated SEQ ID:440, and is provided hereinbelow with reference to the sequence listing part.

VGAM105 host target gene, herein designated VGAM HOST TARGET GENE, encodes a corresponding messenger RNA, VGAM105 host target RNA, herein designated VGAM HOST TARGET RNA. VGAM105 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM105 RNA, herein designated VGAM RNA, binds complementarily to one or more host target binding sites located in untranslated regions of VGAM105 host target RNA, herein designated VGAM HOST TARGET RNA. This complementary binding is due to the fact that the nucleotide sequence of VGAM105 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM105 RNA, herein designated VGAM RNA, may have a different number of host target binding sites in untranslated regions of a VGAM105 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM105 RNA, herein designated VGAM RNA, to host target binding sites on VGAM105 host target RNA, herein designated VGAM HOST TARGET RNA, such as BINDING SITE I, BINDING SITE II and BINDING SITE III, inhibits translation of VGAM105 host target RNA, herein designated VGAM HOST TARGET RNA, into VGAM105 host target protein, herein designated VGAM HOST TARGET PROTEIN. VGAM host target protein is therefore outlined by a broken line.

It is appreciated that VGAM105 host target gene, herein designated VGAM HOST TARGET GENE, in fact represents a plurality of VGAM105 host target genes. The mRNA of each one of this plurality of VGAM105 host target genes comprises one or more host target binding sites, each having a nucleotide sequence which is at least partly complementary to VGAM105 RNA, herein designated VGAM RNA, and which when bound by VGAM105 RNA, herein designated VGAM RNA, causes inhibition of translation of respective one or more VGAM105 host target proteins.

It is further appreciated by one skilled in the art that the mode of translational inhibition illustrated by FIG. 1 with specific reference to translational inhibition exerted by VGAM105 gene, herein designated VGAM GENE, on one or more VGAM105 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM105 is inhibition of expression of host target genes, as part of a novel viral mechanism of attacking a host. Accordingly, utilities of VGAM105 include diagnosis, prevention and treatment of viral infection by Vaccinia virus. Specific functions, and accordingly utilities, of VGAM105 correlate with, and may be deduced from, the identity of the host target genes which VGAM105 binds and inhibits, and the function of these host target genes, as elaborated hereinbelow.

Nucleotide sequences of the VGAM105 precursor RNA, herein designated VGAM PRECURSOR RNA, and of the diced VGAM105 RNA, herein designated VGAM RNA, and a schematic representation of the secondary folding of VGAM105 folded precursor RNA, herein designated VGAM FOLDED PRECURSOR RNA, of VGAM105 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM105 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 106 (VGAM106) viral gene, which modulates expression of respective host target genes thereof, the function and utility of which host target genes is known in the art.

VGAM106 is a novel bioinformatically detected regulatory, non protein coding, viral micro RNA (miRNA) gene. The method by which VGAM106 was detected is described hereinabove with reference to FIGS. 2-8.

VGAM106 gene, herein designated VGAM GENE, is a viral gene contained in the genome of Vaccinia virus. VGAM106 host target gene, herein designated VGAM HOST TARGET GENE, is a human gene contained in the human genome.

VGAM106 gene, herein designated VGAM GENE, encodes a VGAM106 precursor RNA, herein designated VGAM PRECURSOR RNA. Similar to other miRNA genes, and unlike most ordinary genes, VGAM106 precursor RNA, herein designated VGAM PRECURSOR RNA, does not encode a protein. A nucleotide sequence identical or highly similar to the nucleotide sequence of VGAM106 precursor RNA is designated SEQ ID:92, and is provided hereinbelow with reference to the sequence listing part. Nucleotide sequence SEQ ID:92 is located at position 43627 relative to the genome of Vaccinia virus.

VGAM106 precursor RNA, herein designated VGAM PRECURSOR RNA, folds onto itself, forming VGAM106 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM106 folded precursor RNA, herein designated VGAM FOLDED PRECURSOR RNA, into VGAM106 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 81%) nucleotide sequence of VGAM106 RNA is designated SEQ ID:441, and is provided hereinbelow with reference to the sequence listing part.

VGAM106 host target gene, herein designated VGAM HOST TARGET GENE, encodes a corresponding messenger RNA, VGAM106 host target RNA, herein designated VGAM HOST TARGET RNA. VGAM106 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM106 RNA, herein designated VGAM RNA, binds complementarily to one or more host target binding sites located in untranslated regions of VGAM106 host target RNA, herein designated VGAM HOST TARGET RNA. This complementary binding is due to the fact that the nucleotide sequence of VGAM106 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM106 RNA, herein designated VGAM RNA, may have a different number of host target binding sites in untranslated regions of a VGAM106 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM106 RNA, herein designated VGAM RNA, to host target binding sites on VGAM106 host target RNA, herein designated VGAM HOST TARGET RNA, such as BINDING SITE I, BINDING SITE II and BINDING SITE III, inhibits translation of VGAM106 host target RNA, herein designated VGAM HOST TARGET RNA, into VGAM106 host target protein, herein designated VGAM HOST TARGET PROTEIN. VGAM host target protein is therefore outlined by a broken line.

It is appreciated that VGAM106 host target gene, herein designated VGAM HOST TARGET GENE, in fact represents a plurality of VGAM106 host target genes. The mRNA of each one of this plurality of VGAM106 host target genes comprises one or more host target binding sites, each having a nucleotide sequence which is at least partly complementary to VGAM106 RNA, herein designated VGAM RNA, and which when bound by VGAM106 RNA, herein designated VGAM RNA, causes inhibition of translation of respective one or more VGAM106 host target proteins.

It is further appreciated by one skilled in the art that the mode of translational inhibition illustrated by FIG. 1 with specific reference to translational inhibition exerted by VGAM106 gene, herein designated VGAM GENE, on one or more VGAM106 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM106 is inhibition of expression of host target genes, as part of a novel viral mechanism of attacking a host. Accordingly, utilities of VGAM106 include diagnosis, prevention and treatment of viral infection by Vaccinia virus. Specific functions, and accordingly utilities, of VGAM106 correlate with, and may be deduced from, the identity of the host target genes which VGAM106 binds and inhibits, and the function of these host target genes, as elaborated hereinbelow.

Nucleotide sequences of the VGAM106 precursor RNA, herein designated VGAM PRECURSOR RNA, and of the diced VGAM106 RNA, herein designated VGAM RNA, and a schematic representation of the secondary folding of VGAM106 folded precursor RNA, herein designated VGAM FOLDED PRECURSOR RNA, of VGAM106 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM106 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 107 (VGAM107) viral gene, which modulates expression of respective host target genes thereof, the function and utility of which host target genes is known in the art.

VGAM107 is a novel bioinformatically detected regulatory, non protein coding, viral micro RNA (miRNA) gene. The method by which VGAM107 was detected is described hereinabove with reference to FIGS. 2-8.

VGAM107 gene, herein designated VGAM GENE, is a viral gene contained in the genome of Vaccinia virus. VGAM107 host target gene, herein designated VGAM HOST TARGET GENE, is a human gene contained in the human genome.

VGAM107 gene, herein designated VGAM GENE, encodes a VGAM107 precursor RNA, herein designated VGAM PRECURSOR RNA. Similar to other miRNA genes, and unlike most ordinary genes, VGAM107 precursor RNA, herein designated VGAM PRECURSOR RNA, does not encode a protein. A nucleotide sequence identical or highly similar to the nucleotide sequence of VGAM107 precursor RNA is designated SEQ ID:93, and is provided hereinbelow with reference to the sequence listing part. Nucleotide sequence SEQ ID:93 is located at position 44848 relative to the genome of Vaccinia virus.

VGAM107 precursor RNA, herein designated VGAM PRECURSOR RNA, folds onto itself, forming VGAM107 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM107 folded precursor RNA, herein designated VGAM FOLDED PRECURSOR RNA, into VGAM107 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM107 RNA is designated SEQ ID:442, and is provided hereinbelow with reference to the sequence listing part.

VGAM107 host target gene, herein designated VGAM HOST TARGET GENE, encodes a corresponding messenger RNA, VGAM107 host target RNA, herein designated VGAM HOST TARGET RNA. VGAM107 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM107 RNA, herein designated VGAM RNA, binds complementarily to one or more host target binding sites located in untranslated regions of VGAM107 host target RNA, herein designated VGAM HOST TARGET RNA. This complementary binding is due to the fact that the nucleotide sequence of VGAM107 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM107 RNA, herein designated VGAM RNA, may have a different number of host target binding sites in untranslated regions of a VGAM107 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM107 RNA, herein designated VGAM RNA, to host target binding sites on VGAM107 host target RNA, herein designated VGAM HOST TARGET RNA, such as BINDING SITE I, BINDING SITE II and BINDING SITE III, inhibits translation of VGAM107 host target RNA, herein designated VGAM HOST TARGET RNA, into VGAM107 host target protein, herein designated VGAM HOST TARGET PROTEIN. VGAM host target protein is therefore outlined by a broken line.

It is appreciated that VGAM107 host target gene, herein designated VGAM HOST TARGET GENE, in fact represents a plurality of VGAM107 host target genes. The mRNA of each one of this plurality of VGAM107 host target genes comprises one or more host target binding sites, each having a nucleotide sequence which is at least partly complementary to VGAM107 RNA, herein designated VGAM RNA, and which when bound by VGAM107 RNA, herein designated VGAM RNA, causes inhibition of translation of respective one or more VGAM107 host target proteins.

It is further appreciated by one skilled in the art that the mode of translational inhibition illustrated by FIG. 1 with specific reference to translational inhibition exerted by VGAM107 gene, herein designated VGAM GENE, on one or more VGAM107 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM107 is inhibition of expression of host target genes, as part of a novel viral mechanism of attacking a host. Accordingly, utilities of VGAM107 include diagnosis, prevention and treatment of viral infection by Vaccinia virus. Specific functions, and accordingly utilities, of VGAM107 correlate with, and may be deduced from, the identity of the host target genes which VGAM107 binds and inhibits, and the function of these host target genes, as elaborated hereinbelow.

Nucleotide sequences of the VGAM107 precursor RNA, herein designated VGAM PRECURSOR RNA, and of the diced VGAM107 RNA, herein designated VGAM RNA, and a schematic representation of the secondary folding of VGAM107 folded precursor RNA, herein designated VGAM FOLDED PRECURSOR RNA, of VGAM107 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM107 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 108 (VGAM108) viral gene, which modulates expression of respective host target genes thereof, the function and utility of which host target genes is known in the art.

VGAM108 is a novel bioinformatically detected regulatory, non protein coding, viral micro RNA (miRNA) gene. The method by which VGAM108 was detected is described hereinabove with reference to FIGS. 2-8.

VGAM108 gene, herein designated VGAM GENE, is a viral gene contained in the genome of Vaccinia virus. VGAM108 host target gene, herein designated VGAM HOST TARGET GENE, is a human gene contained in the human genome.

VGAM108 gene, herein designated VGAM GENE, encodes a VGAM108 precursor RNA, herein designated VGAM PRECURSOR RNA. Similar to other miRNA genes, and unlike most ordinary genes, VGAM108 precursor RNA, herein designated VGAM PRECURSOR RNA, does not encode a protein. A nucleotide sequence identical or highly similar to the nucleotide sequence of VGAM108 precursor RNA is designated SEQ ID:94, and is provided hereinbelow with reference to the sequence listing part. Nucleotide sequence SEQ ID:94 is located at position 43844 relative to the genome of Vaccinia virus.

VGAM108 precursor RNA, herein designated VGAM PRECURSOR RNA, folds onto itself, forming VGAM108 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM108 folded precursor RNA, herein designated VGAM FOLDED PRECURSOR RNA, into VGAM108 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 90%) nucleotide sequence of VGAM108 RNA is designated SEQ ID:443, and is provided hereinbelow with reference to the sequence listing part.

VGAM108 host target gene, herein designated VGAM HOST TARGET GENE, encodes a corresponding messenger RNA, VGAM108 host target RNA, herein designated VGAM HOST TARGET RNA. VGAM108 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM108 RNA, herein designated VGAM RNA, binds complementarily to one or more host target binding sites located in untranslated regions of VGAM108 host target RNA, herein designated VGAM HOST TARGET RNA. This complementary binding is due to the fact that the nucleotide sequence of VGAM108 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM108 RNA, herein designated VGAM RNA, may have a different number of host target binding sites in untranslated regions of a VGAM108 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM108 RNA, herein designated VGAM RNA, to host target binding sites on VGAM108 host target RNA, herein designated VGAM HOST TARGET RNA, such as BINDING SITE I, BINDING SITE II and BINDING SITE III, inhibits translation of VGAM108 host target RNA, herein designated VGAM HOST TARGET RNA, into VGAM108 host target protein, herein designated VGAM HOST TARGET PROTEIN. VGAM host target protein is therefore outlined by a broken line.

It is appreciated that VGAM108 host target gene, herein designated VGAM HOST TARGET GENE, in fact represents a plurality of VGAM108 host target genes. The mRNA of each one of this plurality of VGAM108 host target genes comprises one or more host target binding sites, each having a nucleotide sequence which is at least partly complementary to VGAM108 RNA, herein designated VGAM RNA, and which when bound by VGAM108 RNA, herein designated VGAM RNA, causes inhibition of translation of respective one or more VGAM108 host target proteins.

It is further appreciated by one skilled in the art that the mode of translational inhibition illustrated by FIG. 1 with specific reference to translational inhibition exerted by VGAM108 gene, herein designated VGAM GENE, on one or more VGAM108 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM108 is inhibition of expression of host target genes, as part of a novel viral mechanism of attacking a host. Accordingly, utilities of VGAM108 include diagnosis, prevention and treatment of viral infection by Vaccinia virus. Specific functions, and accordingly utilities, of VGAM108 correlate with, and may be deduced from, the identity of the host target genes which VGAM108 binds and inhibits, and the function of these host target genes, as elaborated hereinbelow.

Nucleotide sequences of the VGAM108 precursor RNA, herein designated VGAM PRECURSOR RNA, and of the diced VGAM108 RNA, herein designated VGAM RNA, and a schematic representation of the secondary folding of VGAM108 folded precursor RNA, herein designated VGAM FOLDED PRECURSOR RNA, of VGAM108 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM108 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 109 (VGAM109) viral gene, which modulates expression of respective host target genes thereof, the function and utility of which host target genes is known in the art.

VGAM109 is a novel bioinformatically detected regulatory, non protein coding, viral micro RNA (miRNA) gene. The method by which VGAM109 was detected is described hereinabove with reference to FIGS. 2-8.

VGAM109 gene, herein designated VGAM GENE, is a viral gene contained in the genome of Vaccinia virus. VGAM109 host target gene, herein designated VGAM HOST TARGET GENE, is a human gene contained in the human genome.

VGAM109 gene, herein designated VGAM GENE, encodes a VGAM109 precursor RNA, herein designated VGAM PRECURSOR RNA. Similar to other miRNA genes, and unlike most ordinary genes, VGAM109 precursor RNA, herein designated VGAM PRECURSOR RNA, does not encode a protein. A nucleotide sequence identical or highly similar to the nucleotide sequence of VGAM109 precursor RNA is designated SEQ ID:95, and is provided hereinbelow with reference to the sequence listing part. Nucleotide sequence SEQ ID:95 is located at position 46236 relative to the genome of Vaccinia virus.

VGAM109 precursor RNA, herein designated VGAM PRECURSOR RNA, folds onto itself, forming VGAM109 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM109 folded precursor RNA, herein designated VGAM FOLDED PRECURSOR RNA, into VGAM109 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 79%) nucleotide sequence of VGAM109 RNA is designated SEQ ID:444, and is provided hereinbelow with reference to the sequence listing part.

VGAM109 host target gene, herein designated VGAM HOST TARGET GENE, encodes a corresponding messenger RNA, VGAM109 host target RNA, herein designated VGAM HOST TARGET RNA. VGAM109 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM109 RNA, herein designated VGAM RNA, binds complementarily to one or more host target binding sites located in untranslated regions of VGAM109 host target RNA, herein designated VGAM HOST TARGET RNA. This complementary binding is due to the fact that the nucleotide sequence of VGAM109 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM109 RNA, herein designated VGAM RNA, may have a different number of host target binding sites in untranslated regions of a VGAM109 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM109 RNA, herein designated VGAM RNA, to host target binding sites on VGAM109 host target RNA, herein designated VGAM HOST TARGET RNA, such as BINDING SITE I, BINDING SITE II and BINDING SITE III, inhibits translation of VGAM109 host target RNA, herein designated VGAM HOST TARGET RNA, into VGAM109 host target protein, herein designated VGAM HOST TARGET PROTEIN. VGAM host target protein is therefore outlined by a broken line.

It is appreciated that VGAM109 host target gene, herein designated VGAM HOST TARGET GENE, in fact represents a plurality of VGAM109 host target genes. The mRNA of each one of this plurality of VGAM109 host target genes comprises one or more host target binding sites, each having a nucleotide sequence which is at least partly complementary to VGAM109 RNA, herein designated VGAM RNA, and which when bound by VGAM109 RNA, herein designated VGAM RNA, causes inhibition of translation of respective one or more VGAM109 host target proteins.

It is further appreciated by one skilled in the art that the mode of translational inhibition illustrated by FIG. 1 with specific reference to translational inhibition exerted by VGAM109 gene, herein designated VGAM GENE, on one or more VGAM109 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM109 is inhibition of expression of host target genes, as part of a novel viral mechanism of attacking a host. Accordingly, utilities of VGAM109 include diagnosis, prevention and treatment of viral infection by Vaccinia virus. Specific functions, and accordingly utilities, of VGAM109 correlate with, and may be deduced from, the identity of the host target genes which VGAM109 binds and inhibits, and the function of these host target genes, as elaborated hereinbelow.

Nucleotide sequences of the VGAM109 precursor RNA, herein designated VGAM PRECURSOR RNA, and of the diced VGAM109 RNA, herein designated VGAM RNA, and a schematic representation of the secondary folding of VGAM109 folded precursor RNA, herein designated VGAM FOLDED PRECURSOR RNA, of VGAM109 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM109 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 110 (VGAM110) viral gene, which modulates expression of respective host target genes thereof, the function and utility of which host target genes is known in the art.

VGAM110 is a novel bioinformatically detected regulatory, non protein coding, viral micro RNA (miRNA) gene. The method by which VGAM110 was detected is described hereinabove with reference to FIGS. 2-8.

VGAM110 gene, herein designated VGAM GENE, is a viral gene contained in the genome of Vaccinia virus. VGAM110 host target gene, herein designated VGAM HOST TARGET GENE, is a human gene contained in the human genome.

VGAM110 gene, herein designated VGAM GENE, encodes a VGAM110 precursor RNA, herein designated VGAM PRECURSOR RNA. Similar to other miRNA genes, and unlike most ordinary genes, VGAM110 precursor RNA, herein designated VGAM PRECURSOR RNA, does not encode a protein. A nucleotide sequence identical or highly similar to the nucleotide sequence of VGAM110 precursor RNA is designated SEQ ID:96, and is provided hereinbelow with reference to the sequence listing part. Nucleotide sequence SEQ ID:96 is located at position 51758 relative to the genome of Vaccinia virus.

VGAM110 precursor RNA, herein designated VGAM PRECURSOR RNA, folds onto itself, forming VGAM110 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM110 folded precursor RNA, herein designated VGAM FOLDED PRECURSOR RNA, into VGAM110 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM110 RNA is designated SEQ ID:445, and is provided hereinbelow with reference to the sequence listing part.

VGAM110 host target gene, herein designated VGAM HOST TARGET GENE, encodes a corresponding messenger RNA, VGAM110 host target RNA, herein designated VGAM HOST TARGET RNA. VGAM110 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM110 RNA, herein designated VGAM RNA, binds complementarily to one or more host target binding sites located in untranslated regions of VGAM110 host target RNA, herein designated VGAM HOST TARGET RNA. This complementary binding is due to the fact that the nucleotide sequence of VGAM110 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM110 RNA, herein designated VGAM RNA, may have a different number of host target binding sites in untranslated regions of a VGAM110 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM110 RNA, herein designated VGAM RNA, to host target binding sites on VGAM110 host target RNA, herein designated VGAM HOST TARGET RNA, such as BINDING SITE I, BINDING SITE II and BINDING SITE III, inhibits translation of VGAM110 host target RNA, herein designated VGAM HOST TARGET RNA, into VGAM110 host target protein, herein designated VGAM HOST TARGET PROTEIN. VGAM host target protein is therefore outlined by a broken line.

It is appreciated that VGAM110 host target gene, herein designated VGAM HOST TARGET GENE, in fact represents a plurality of VGAM110 host target genes. The mRNA of each one of this plurality of VGAM110 host target genes comprises one or more host target binding sites, each having a nucleotide sequence which is at least partly complementary to VGAM110 RNA, herein designated VGAM RNA, and which when bound by VGAM110 RNA, herein designated VGAM RNA, causes inhibition of translation of respective one or more VGAM110 host target proteins.

It is further appreciated by one skilled in the art that the mode of translational inhibition illustrated by FIG. 1 with specific reference to translational inhibition exerted by VGAM110 gene, herein designated VGAM GENE, on one or more VGAM110 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM110 is inhibition of expression of host target genes, as part of a novel viral mechanism of attacking a host. Accordingly, utilities of VGAM110 include diagnosis, prevention and treatment of viral infection by Vaccinia virus. Specific functions, and accordingly utilities, of VGAM110 correlate with, and may be deduced from, the identity of the host target genes which VGAM110 binds and inhibits, and the function of these host target genes, as elaborated hereinbelow.

Nucleotide sequences of the VGAM110 precursor RNA, herein designated VGAM PRECURSOR RNA, and of the diced VGAM110 RNA, herein designated VGAM RNA, and a schematic representation of the secondary folding of VGAM110 folded precursor RNA, herein designated VGAM FOLDED PRECURSOR RNA, of VGAM110 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM110 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 111 (VGAM111) viral gene, which modulates expression of respective host target genes thereof, the function and utility of which host target genes is known in the art.

VGAM111 is a novel bioinformatically detected regulatory, non protein coding, viral micro RNA (miRNA) gene. The method by which VGAM111 was detected is described hereinabove with reference to FIGS. 2-8.

VGAM111 gene, herein designated VGAM GENE, is a viral gene contained in the genome of Vaccinia virus. VGAM111 host target gene, herein designated VGAM HOST TARGET GENE, is a human gene contained in the human genome.

VGAM111 gene, herein designated VGAM GENE, encodes a VGAM111 precursor RNA, herein designated VGAM PRECURSOR RNA. Similar to other miRNA genes, and unlike most ordinary genes, VGAM111 precursor RNA, herein designated VGAM PRECURSOR RNA, does not encode a protein. A nucleotide sequence identical or highly similar to the nucleotide sequence of VGAM111 precursor RNA is designated SEQ ID:97, and is provided hereinbelow with reference to the sequence listing part. Nucleotide sequence SEQ ID:97 is located at position 51252 relative to the genome of Vaccinia virus.

VGAM111 precursor RNA, herein designated VGAM PRECURSOR RNA, folds onto itself, forming VGAM111 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM111 folded precursor RNA, herein designated VGAM FOLDED PRECURSOR RNA, into VGAM111 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 25%) nucleotide sequence of VGAM111 RNA is designated SEQ ID:446, and is provided hereinbelow with reference to the sequence listing part.

VGAM111 host target gene, herein designated VGAM HOST TARGET GENE, encodes a corresponding messenger RNA, VGAM111 host target RNA, herein designated VGAM HOST TARGET RNA. VGAM111 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM111 RNA, herein designated VGAM RNA, binds complementarily to one or more host target binding sites located in untranslated regions of VGAM111 host target RNA, herein designated VGAM HOST TARGET RNA. This complementary binding is due to the fact that the nucleotide sequence of VGAM111 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM111 RNA, herein designated VGAM RNA, may have a different number of host target binding sites in untranslated regions of a VGAM111 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM111 RNA, herein designated VGAM RNA, to host target binding sites on VGAM111 host target RNA, herein designated VGAM HOST TARGET RNA, such as BINDING SITE I, BINDING SITE II and BINDING SITE III, inhibits translation of VGAM111 host target RNA, herein designated VGAM HOST TARGET RNA, into VGAM111 host target protein, herein designated VGAM HOST TARGET PROTEIN. VGAM host target protein is therefore outlined by a broken line.

It is appreciated that VGAM111 host target gene, herein designated VGAM HOST TARGET GENE, in fact represents a plurality of VGAM111 host target genes. The mRNA of each one of this plurality of VGAM111 host target genes comprises one or more host target binding sites, each having a nucleotide sequence which is at least partly complementary to VGAM111 RNA, herein designated VGAM RNA, and which when bound by VGAM111 RNA, herein designated VGAM RNA, causes inhibition of translation of respective one or more VGAM111 host target proteins.

It is further appreciated by one skilled in the art that the mode of translational inhibition illustrated by FIG. 1 with specific reference to translational inhibition exerted by VGAM111 gene, herein designated VGAM GENE, on one or more VGAM111 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM111 is inhibition of expression of host target genes, as part of a novel viral mechanism of attacking a host. Accordingly, utilities of VGAM111 include diagnosis, prevention and treatment of viral infection by Vaccinia virus. Specific functions, and accordingly utilities, of VGAM111 correlate with, and may be deduced from, the identity of the host target genes which VGAM111 binds and inhibits, and the function of these host target genes, as elaborated hereinbelow.

Nucleotide sequences of the VGAM111 precursor RNA, herein designated VGAM PRECURSOR RNA, and of the diced VGAM111 RNA, herein designated VGAM RNA, and a schematic representation of the secondary folding of VGAM111 folded precursor RNA, herein designated VGAM FOLDED PRECURSOR RNA, of VGAM111 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM111 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 112 (VGAM112) viral gene, which modulates expression of respective host target genes thereof, the function and utility of which host target genes is known in the art.

VGAM112 is a novel bioinformatically detected regulatory, non protein coding, viral micro RNA (miRNA) gene. The method by which VGAM112 was detected is described hereinabove with reference to FIGS. 2-8.

VGAM112 gene, herein designated VGAM GENE, is a viral gene contained in the genome of Vaccinia virus. VGAM112 host target gene, herein designated VGAM HOST TARGET GENE, is a human gene contained in the human genome.

VGAM112 gene, herein designated VGAM GENE, encodes a VGAM112 precursor RNA, herein designated VGAM PRECURSOR RNA. Similar to other miRNA genes, and unlike most ordinary genes, VGAM112 precursor RNA, herein designated VGAM PRECURSOR RNA, does not encode a protein. A nucleotide sequence identical or highly similar to the nucleotide sequence of VGAM112 precursor RNA is designated SEQ ID:98, and is provided hereinbelow with reference to the sequence listing part. Nucleotide sequence SEQ ID:98 is located at position 50148 relative to the genome of Vaccinia virus.

VGAM112 precursor RNA, herein designated VGAM PRECURSOR RNA, folds onto itself, forming VGAM112 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM112 folded precursor RNA, herein designated VGAM FOLDED PRECURSOR RNA, into VGAM112 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM112 RNA is designated SEQ ID:447, and is provided hereinbelow with reference to the sequence listing part.

VGAM112 host target gene, herein designated VGAM HOST TARGET GENE, encodes a corresponding messenger RNA, VGAM112 host target RNA, herein designated VGAM HOST TARGET RNA. VGAM112 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM112 RNA, herein designated VGAM RNA, binds complementarily to one or more host target binding sites located in untranslated regions of VGAM112 host target RNA, herein designated VGAM HOST TARGET RNA. This complementary binding is due to the fact that the nucleotide sequence of VGAM112 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM112 RNA, herein designated VGAM RNA, may have a different number of host target binding sites in untranslated regions of a VGAM112 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM112 RNA, herein designated VGAM RNA, to host target binding sites on VGAM112 host target RNA, herein designated VGAM HOST TARGET RNA, such as BINDING SITE I, BINDING SITE II and BINDING SITE III, inhibits translation of VGAM112 host target RNA, herein designated VGAM HOST TARGET RNA, into VGAM112 host target protein, herein designated VGAM HOST TARGET PROTEIN. VGAM host target protein is therefore outlined by a broken line.

It is appreciated that VGAM112 host target gene, herein designated VGAM HOST TARGET GENE, in fact represents a plurality of VGAM112 host target genes. The mRNA of each one of this plurality of VGAM112 host target genes comprises one or more host target binding sites, each having a nucleotide sequence which is at least partly complementary to VGAM112 RNA, herein designated VGAM RNA, and which when bound by VGAM112 RNA, herein designated VGAM RNA, causes inhibition of translation of respective one or more VGAM112 host target proteins.

It is further appreciated by one skilled in the art that the mode of translational inhibition illustrated by FIG. 1 with specific reference to translational inhibition exerted by VGAM112 gene, herein designated VGAM GENE, on one or more VGAM112 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM112 is inhibition of expression of host target genes, as part of a novel viral mechanism of attacking a host. Accordingly, utilities of VGAM112 include diagnosis, prevention and treatment of viral infection by Vaccinia virus. Specific functions, and accordingly utilities, of VGAM112 correlate with, and may be deduced from, the identity of the host target genes which VGAM112 binds and inhibits, and the function of these host target genes, as elaborated hereinbelow.

Nucleotide sequences of the VGAM112 precursor RNA, herein designated VGAM PRECURSOR RNA, and of the diced VGAM112 RNA, herein designated VGAM RNA, and a schematic representation of the secondary folding of VGAM112 folded precursor RNA, herein designated VGAM FOLDED PRECURSOR RNA, of VGAM112 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM112 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 113 (VGAM113) viral gene, which modulates expression of respective host target genes thereof, the function and utility of which host target genes is known in the art.

VGAM113 is a novel bioinformatically detected regulatory, non protein coding, viral micro RNA (miRNA) gene. The method by which VGAM113 was detected is described hereinabove with reference to FIGS. 2-8.

VGAM113 gene, herein designated VGAM GENE, is a viral gene contained in the genome of Vaccinia virus. VGAM113 host target gene, herein designated VGAM HOST TARGET GENE, is a human gene contained in the human genome.

VGAM113 gene, herein designated VGAM GENE, encodes a VGAM113 precursor RNA, herein designated VGAM PRECURSOR RNA. Similar to other miRNA genes, and unlike most ordinary genes, VGAM113 precursor RNA, herein designated VGAM PRECURSOR RNA, does not encode a protein. A nucleotide sequence identical or highly similar to the nucleotide sequence of VGAM113 precursor RNA is designated SEQ ID:99, and is provided hereinbelow with reference to the sequence listing part. Nucleotide sequence SEQ ID:99 is located at position 49143 relative to the genome of Vaccinia virus.

VGAM113 precursor RNA, herein designated VGAM PRECURSOR RNA, folds onto itself, forming VGAM113 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM113 folded precursor RNA, herein designated VGAM FOLDED PRECURSOR RNA, into VGAM113 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM113 RNA is designated SEQ ID:448, and is provided hereinbelow with reference to the sequence listing part.

VGAM113 host target gene, herein designated VGAM HOST TARGET GENE, encodes a corresponding messenger RNA, VGAM113 host target RNA, herein designated VGAM HOST TARGET RNA. VGAM113 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM113 RNA, herein designated VGAM RNA, binds complementarily to one or more host target binding sites located in untranslated regions of VGAM113 host target RNA, herein designated VGAM HOST TARGET RNA. This complementary binding is due to the fact that the nucleotide sequence of VGAM113 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM113 RNA, herein designated VGAM RNA, may have a different number of host target binding sites in untranslated regions of a VGAM113 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM113 RNA, herein designated VGAM RNA, to host target binding sites on VGAM113 host target RNA, herein designated VGAM HOST TARGET RNA, such as BINDING SITE I, BINDING SITE II and BINDING SITE III, inhibits translation of VGAM113 host target RNA, herein designated VGAM HOST TARGET RNA, into VGAM113 host target protein, herein designated VGAM HOST TARGET PROTEIN. VGAM host target protein is therefore outlined by a broken line.

It is appreciated that VGAM113 host target gene, herein designated VGAM HOST TARGET GENE, in fact represents a plurality of VGAM113 host target genes. The mRNA of each one of this plurality of VGAM113 host target genes comprises one or more host target binding sites, each having a nucleotide sequence which is at least partly complementary to VGAM113 RNA, herein designated VGAM RNA, and which when bound by VGAM113 RNA, herein designated VGAM RNA, causes inhibition of translation of respective one or more VGAM113 host target proteins.

It is further appreciated by one skilled in the art that the mode of translational inhibition illustrated by FIG. 1 with specific reference to translational inhibition exerted by VGAM113 gene, herein designated VGAM GENE, on one or more VGAM113 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM113 is inhibition of expression of host target genes, as part of a novel viral mechanism of attacking a host. Accordingly, utilities of VGAM113 include diagnosis, prevention and treatment of viral infection by Vaccinia virus. Specific functions, and accordingly utilities, of VGAM113 correlate with, and may be deduced from, the identity of the host target genes which VGAM113 binds and inhibits, and the function of these host target genes, as elaborated hereinbelow.

Nucleotide sequences of the VGAM113 precursor RNA, herein designated VGAM PRECURSOR RNA, and of the diced VGAM113 RNA, herein designated VGAM RNA, and a schematic representation of the secondary folding of VGAM113 folded precursor RNA, herein designated VGAM FOLDED PRECURSOR RNA, of VGAM113 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM113 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 114 (VGAM114) viral gene, which modulates expression of respective host target genes thereof, the function and utility of which host target genes is known in the art.

VGAM114 is a novel bioinformatically detected regulatory, non protein coding, viral micro RNA (miRNA) gene. The method by which VGAM114 was detected is described hereinabove with reference to FIGS. 2-8.

VGAM114 gene, herein designated VGAM GENE, is a viral gene contained in the genome of Vaccinia virus. VGAM114 host target gene, herein designated VGAM HOST TARGET GENE, is a human gene contained in the human genome.

VGAM114 gene, herein designated VGAM GENE, encodes a VGAM114 precursor RNA, herein designated VGAM PRECURSOR RNA. Similar to other miRNA genes, and unlike most ordinary genes, VGAM114 precursor RNA, herein designated VGAM PRECURSOR RNA, does not encode a protein. A nucleotide sequence identical or highly similar to the nucleotide sequence of VGAM114 precursor RNA is designated SEQ ID:100, and is provided hereinbelow with reference to the sequence listing part. Nucleotide sequence SEQ ID: 100 is located at position 49722 relative to the genome of Vaccinia virus.

VGAM114 precursor RNA, herein designated VGAM PRECURSOR RNA, folds onto itself, forming VGAM114 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM114 folded precursor RNA, herein designated VGAM FOLDED PRECURSOR RNA, into VGAM114 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 74%) nucleotide sequence of VGAM114 RNA is designated SEQ ID:449, and is provided hereinbelow with reference to the sequence listing part.

VGAM114 host target gene, herein designated VGAM HOST TARGET GENE, encodes a corresponding messenger RNA, VGAM114 host target RNA, herein designated VGAM HOST TARGET RNA. VGAM114 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM114 RNA, herein designated VGAM RNA, binds complementarily to one or more host target binding sites located in untranslated regions of VGAM114 host target RNA, herein designated VGAM HOST TARGET RNA. This complementary binding is due to the fact that the nucleotide sequence of VGAM114 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM114 RNA, herein designated VGAM RNA, may have a different number of host target binding sites in untranslated regions of a VGAM114 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM114 RNA, herein designated VGAM RNA, to host target binding sites on VGAM114 host target RNA, herein designated VGAM HOST TARGET RNA, such as BINDING SITE I, BINDING SITE II and BINDING SITE III, inhibits translation of VGAM114 host target RNA, herein designated VGAM HOST TARGET RNA, into VGAM114 host target protein, herein designated VGAM HOST TARGET PROTEIN. VGAM host target protein is therefore outlined by a broken line.

It is appreciated that VGAM114 host target gene, herein designated VGAM HOST TARGET GENE, in fact represents a plurality of VGAM114 host target genes. The mRNA of each one of this plurality of VGAM114 host target genes comprises one or more host target binding sites, each having a nucleotide sequence which is at least partly complementary to VGAM114 RNA, herein designated VGAM RNA, and which when bound by VGAM114 RNA, herein designated VGAM RNA, causes inhibition of translation of respective one or more VGAM114 host target proteins.

It is further appreciated by one skilled in the art that the mode of translational inhibition illustrated by FIG. 1 with specific reference to translational inhibition exerted by VGAM114 gene, herein designated VGAM GENE, on one or more VGAM114 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM114 is inhibition of expression of host target genes, as part of a novel viral mechanism of attacking a host. Accordingly, utilities of VGAM114 include diagnosis, prevention and treatment of viral infection by Vaccinia virus. Specific functions, and accordingly utilities, of VGAM114 correlate with, and may be deduced from, the identity of the host target genes which VGAM114 binds and inhibits, and the function of these host target genes, as elaborated hereinbelow.

Nucleotide sequences of the VGAM114 precursor RNA, herein designated VGAM PRECURSOR RNA, and of the diced VGAM114 RNA, herein designated VGAM RNA, and a schematic representation of the secondary folding of VGAM114 folded precursor RNA, herein designated VGAM FOLDED PRECURSOR RNA, of VGAM114 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM114 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 115 (VGAM115) viral gene, which modulates expression of respective host target genes thereof, the function and utility of which host target genes is known in the art.

VGAM115 is a novel bioinformatically detected regulatory, non protein coding, viral micro RNA (miRNA) gene. The method by which VGAM115 was detected is described hereinabove with reference to FIGS. 2-8.

VGAM115 gene, herein designated VGAM GENE, is a viral gene contained in the genome of Vaccinia virus. VGAM115 host target gene, herein designated VGAM HOST TARGET GENE, is a human gene contained in the human genome.

VGAM115 gene, herein designated VGAM GENE, encodes a VGAM115 precursor RNA, herein designated VGAM PRECURSOR RNA. Similar to other miRNA genes, and unlike most ordinary genes, VGAM115 precursor RNA, herein designated VGAM PRECURSOR RNA, does not encode a protein. A nucleotide sequence identical or highly similar to the nucleotide sequence of VGAM115 precursor RNA is designated SEQ ID:101, and is provided hereinbelow with reference to the sequence listing part. Nucleotide sequence SEQ ID: 101 is located at position 49784 relative to the genome of Vaccinia virus.

VGAM115 precursor RNA, herein designated VGAM PRECURSOR RNA, folds onto itself, forming VGAM115 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM115 folded precursor RNA, herein designated VGAM FOLDED PRECURSOR RNA, into VGAM115 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM115 RNA is designated SEQ ID:450, and is provided hereinbelow with reference to the sequence listing part.

VGAM115 host target gene, herein designated VGAM HOST TARGET GENE, encodes a corresponding messenger RNA, VGAM115 host target RNA, herein designated VGAM HOST TARGET RNA. VGAM115 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM115 RNA, herein designated VGAM RNA, binds complementarily to one or more host target binding sites located in untranslated regions of VGAM115 host target RNA, herein designated VGAM HOST TARGET RNA. This complementary binding is due to the fact that the nucleotide sequence of VGAM115 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM115 RNA, herein designated VGAM RNA, may have a different number of host target binding sites in untranslated regions of a VGAM115 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM115 RNA, herein designated VGAM RNA, to host target binding sites on VGAM115 host target RNA, herein designated VGAM HOST TARGET RNA, such as BINDING SITE I, BINDING SITE II and BINDING SITE III, inhibits translation of VGAM115 host target RNA, herein designated VGAM HOST TARGET RNA, into VGAM115 host target protein, herein designated VGAM HOST TARGET PROTEIN. VGAM host target protein is therefore outlined by a broken line.

It is appreciated that VGAM115 host target gene, herein designated VGAM HOST TARGET GENE, in fact represents a plurality of VGAM115 host target genes. The mRNA of each one of this plurality of VGAM115 host target genes comprises one or more host target binding sites, each having a nucleotide sequence which is at least partly complementary to VGAM115 RNA, herein designated VGAM RNA, and which when bound by VGAM115 RNA, herein designated VGAM RNA, causes inhibition of translation of respective one or more VGAM115 host target proteins.

It is further appreciated by one skilled in the art that the mode of translational inhibition illustrated by FIG. 1 with specific reference to translational inhibition exerted by VGAM115 gene, herein designated VGAM GENE, on one or more VGAM115 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM115 is inhibition of expression of host target genes, as part of a novel viral mechanism of attacking a host. Accordingly, utilities of VGAM115 include diagnosis, prevention and treatment of viral infection by Vaccinia virus. Specific functions, and accordingly utilities, of VGAM115 correlate with, and may be deduced from, the identity of the host target genes which VGAM115 binds and inhibits, and the function of these host target genes, as elaborated hereinbelow.

Nucleotide sequences of the VGAM115 precursor RNA, herein designated VGAM PRECURSOR RNA, and of the diced VGAM115 RNA, herein designated VGAM RNA, and a schematic representation of the secondary folding of VGAM115 folded precursor RNA, herein designated VGAM FOLDED PRECURSOR RNA, of VGAM115 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM115 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 116 (VGAM116) viral gene, which modulates expression of respective host target genes thereof, the function and utility of which host target genes is known in the art.

VGAM116 is a novel bioinformatically detected regulatory, non protein coding, viral micro RNA (miRNA) gene. The method by which VGAM116 was detected is described hereinabove with reference to FIGS. 2-8.

VGAM116 gene, herein designated VGAM GENE, is a viral gene contained in the genome of Vaccinia virus. VGAM116 host target gene, herein designated VGAM HOST TARGET GENE, is a human gene contained in the human genome.

VGAM116 gene, herein designated VGAM GENE, encodes a VGAM116 precursor RNA, herein designated VGAM PRECURSOR RNA. Similar to other miRNA genes, and unlike most ordinary genes, VGAM116 precursor RNA, herein designated VGAM PRECURSOR RNA, does not encode a protein. A nucleotide sequence identical or highly similar to the nucleotide sequence of VGAM116 precursor RNA is designated SEQ ID:102, and is provided hereinbelow with reference to the sequence listing part. Nucleotide sequence SEQ ID: 102 is located at position 48815 relative to the genome of Vaccinia virus.

VGAM116 precursor RNA, herein designated VGAM PRECURSOR RNA, folds onto itself, forming VGAM116 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM116 folded precursor RNA, herein designated VGAM FOLDED PRECURSOR RNA, into VGAM116 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM116 RNA is designated SEQ ID:451, and is provided hereinbelow with reference to the sequence listing part.

VGAM116 host target gene, herein designated VGAM HOST TARGET GENE, encodes a corresponding messenger RNA, VGAM116 host target RNA, herein designated VGAM HOST TARGET RNA. VGAM116 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM116 RNA, herein designated VGAM RNA, binds complementarily to one or more host target binding sites located in untranslated regions of VGAM116 host target RNA, herein designated VGAM HOST TARGET RNA. This complementary binding is due to the fact that the nucleotide sequence of VGAM116 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM116 RNA, herein designated VGAM RNA, may have a different number of host target binding sites in untranslated regions of a VGAM116 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM116 RNA, herein designated VGAM RNA, to host target binding sites on VGAM116 host target RNA, herein designated VGAM HOST TARGET RNA, such as BINDING SITE I, BINDING SITE II and BINDING SITE III, inhibits translation of VGAM116 host target RNA, herein designated VGAM HOST TARGET RNA, into VGAM116 host target protein, herein designated VGAM HOST TARGET PROTEIN. VGAM host target protein is therefore outlined by a broken line.

It is appreciated that VGAM116 host target gene, herein designated VGAM HOST TARGET GENE, in fact represents a plurality of VGAM116 host target genes. The mRNA of each one of this plurality of VGAM116 host target genes comprises one or more host target binding sites, each having a nucleotide sequence which is at least partly complementary to VGAM116 RNA, herein designated VGAM RNA, and which when bound by VGAM116 RNA, herein designated VGAM RNA, causes inhibition of translation of respective one or more VGAM116 host target proteins.

It is further appreciated by one skilled in the art that the mode of translational inhibition illustrated by FIG. 1 with specific reference to translational inhibition exerted by VGAM116 gene, herein designated VGAM GENE, on one or more VGAM116 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM116 is inhibition of expression of host target genes, as part of a novel viral mechanism of attacking a host. Accordingly, utilities of VGAM116 include diagnosis, prevention and treatment of viral infection by Vaccinia virus. Specific functions, and accordingly utilities, of VGAM116 correlate with, and may be deduced from, the identity of the host target genes which VGAM116 binds and inhibits, and the function of these host target genes, as elaborated hereinbelow.

Nucleotide sequences of the VGAM116 precursor RNA, herein designated VGAM PRECURSOR RNA, and of the diced VGAM116 RNA, herein designated VGAM RNA, and a schematic representation of the secondary folding of VGAM116 folded precursor RNA, herein designated VGAM FOLDED PRECURSOR RNA, of VGAM116 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM116 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 117 (VGAM117) viral gene, which modulates expression of respective host target genes thereof, the function and utility of which host target genes is known in the art.

VGAM117 is a novel bioinformatically detected regulatory, non protein coding, viral micro RNA (miRNA) gene. The method by which VGAM117 was detected is described hereinabove with reference to FIGS. 2-8.

VGAM117 gene, herein designated VGAM GENE, is a viral gene contained in the genome of Vaccinia virus. VGAM117 host target gene, herein designated VGAM HOST TARGET GENE, is a human gene contained in the human genome.

VGAM117 gene, herein designated VGAM GENE, encodes a VGAM117 precursor RNA, herein designated VGAM PRECURSOR RNA. Similar to other miRNA genes, and unlike most ordinary genes, VGAM117 precursor RNA, herein designated VGAM PRECURSOR RNA, does not encode a protein. A nucleotide sequence identical or highly similar to the nucleotide sequence of VGAM117 precursor RNA is designated SEQ ID:103, and is provided hereinbelow with reference to the sequence listing part. Nucleotide sequence SEQ ID:103 is located at position 51120 relative to the genome of Vaccinia virus.

VGAM117 precursor RNA, herein designated VGAM PRECURSOR RNA, folds onto itself, forming VGAM117 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM117 folded precursor RNA, herein designated VGAM FOLDED PRECURSOR RNA, into VGAM117 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 79%) nucleotide sequence of VGAM117 RNA is designated SEQ ID:452, and is provided hereinbelow with reference to the sequence listing part.

VGAM117 host target gene, herein designated VGAM HOST TARGET GENE, encodes a corresponding messenger RNA, VGAM117 host target RNA, herein designated VGAM HOST TARGET RNA. VGAM117 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM117 RNA, herein designated VGAM RNA, binds complementarily to one or more host target binding sites located in untranslated regions of VGAM117 host target RNA, herein designated VGAM HOST TARGET RNA. This complementary binding is due to the fact that the nucleotide sequence of VGAM117 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM117 RNA, herein designated VGAM RNA, may have a different number of host target binding sites in untranslated regions of a VGAM117 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM117 RNA, herein designated VGAM RNA, to host target binding sites on VGAM117 host target RNA, herein designated VGAM HOST TARGET RNA, such as BINDING SITE I, BINDING SITE II and BINDING SITE III, inhibits translation of VGAM117 host target RNA, herein designated VGAM HOST TARGET RNA, into VGAM117 host target protein, herein designated VGAM HOST TARGET PROTEIN. VGAM host target protein is therefore outlined by a broken line.

It is appreciated that VGAM117 host target gene, herein designated VGAM HOST TARGET GENE, in fact represents a plurality of VGAM117 host target genes. The mRNA of each one of this plurality of VGAM117 host target genes comprises one or more host target binding sites, each having a nucleotide sequence which is at least partly complementary to VGAM117 RNA, herein designated VGAM RNA, and which when bound by VGAM117 RNA, herein designated VGAM RNA, causes inhibition of translation of respective one or more VGAM117 host target proteins.

It is further appreciated by one skilled in the art that the mode of translational inhibition illustrated by FIG. 1 with specific reference to translational inhibition exerted by VGAM117 gene, herein designated VGAM GENE, on one or more VGAM117 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM117 is inhibition of expression of host target genes, as part of a novel viral mechanism of attacking a host. Accordingly, utilities of VGAM117 include diagnosis, prevention and treatment of viral infection by Vaccinia virus. Specific functions, and accordingly utilities, of VGAM117 correlate with, and may be deduced from, the identity of the host target genes which VGAM117 binds and inhibits, and the function of these host target genes, as elaborated hereinbelow.

Nucleotide sequences of the VGAM117 precursor RNA, herein designated VGAM PRECURSOR RNA, and of the diced VGAM117 RNA, herein designated VGAM RNA, and a schematic representation of the secondary folding of VGAM117 folded precursor RNA, herein designated VGAM FOLDED PRECURSOR RNA, of VGAM117 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM117 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 118 (VGAM118) viral gene, which modulates expression of respective host target genes thereof, the function and utility of which host target genes is known in the art.

VGAM118 is a novel bioinformatically detected regulatory, non protein coding, viral micro RNA (miRNA) gene.

The method by which VGAM118 was detected is described hereinabove with reference to FIGS. 2-8.

VGAM118 gene, herein designated VGAM GENE, is a viral gene contained in the genome of Vaccinia virus. VGAM118 host target gene, herein designated VGAM HOST TARGET GENE, is a human gene contained in the human genome.

VGAM118 gene, herein designated VGAM GENE, encodes a VGAM118 precursor RNA, herein designated VGAM PRECURSOR RNA. Similar to other miRNA genes, and unlike most ordinary genes, VGAM118 precursor RNA, herein designated VGAM PRECURSOR RNA, does not encode a protein. A nucleotide sequence identical or highly similar to the nucleotide sequence of VGAM118 precursor RNA is designated SEQ ID:104, and is provided hereinbelow with reference to the sequence listing part. Nucleotide sequence SEQ ID: 104 is located at position 50980 relative to the genome of Vaccinia virus.

VGAM118 precursor RNA, herein designated VGAM PRECURSOR RNA, folds onto itself, forming VGAM118 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM118 folded precursor RNA, herein designated VGAM FOLDED PRECURSOR RNA, into VGAM118 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM118 RNA is designated SEQ ID:453, and is provided hereinbelow with reference to the sequence listing part.

VGAM118 host target gene, herein designated VGAM HOST TARGET GENE, encodes a corresponding messenger RNA, VGAM118 host target RNA, herein designated VGAM HOST TARGET RNA. VGAM118 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM118 RNA, herein designated VGAM RNA, binds complementarily to one or more host target binding sites located in untranslated regions of VGAM118 host target RNA, herein designated VGAM HOST TARGET RNA. This complementary binding is due to the fact that the nucleotide sequence of VGAM118 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM118 RNA, herein designated VGAM RNA, may have a different number of host target binding sites in untranslated regions of a VGAM118 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM118 RNA, herein designated VGAM RNA, to host target binding sites on VGAM118 host target RNA, herein designated VGAM HOST TARGET RNA, such as BINDING SITE I, BINDING SITE II and BINDING SITE III, inhibits translation of VGAM118 host target RNA, herein designated VGAM HOST TARGET RNA, into VGAM118 host target protein, herein designated VGAM HOST TARGET PROTEIN. VGAM host target protein is therefore outlined by a broken line.

It is appreciated that VGAM118 host target gene, herein designated VGAM HOST TARGET GENE, in fact represents a plurality of VGAM118 host target genes. The mRNA of each one of this plurality of VGAM118 host target genes comprises one or more host target binding sites, each having a nucleotide sequence which is at least partly complementary to VGAM118 RNA, herein designated VGAM RNA, and which when bound by VGAM118 RNA, herein designated VGAM RNA, causes inhibition of translation of respective one or more VGAM118 host target proteins.

It is further appreciated by one skilled in the art that the mode of translational inhibition illustrated by FIG. 1 with specific reference to translational inhibition exerted by VGAM118 gene, herein designated VGAM GENE, on one or more VGAM118 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM118 is inhibition of expression of host target genes, as part of a novel viral mechanism of attacking a host. Accordingly, utilities of VGAM118 include diagnosis, prevention and treatment of viral infection by Vaccinia virus. Specific functions, and accordingly utilities, of VGAM118 correlate with, and may be deduced from, the identity of the host target genes which VGAM118 binds and inhibits, and the function of these host target genes, as elaborated hereinbelow.

Nucleotide sequences of the VGAM118 precursor RNA, herein designated VGAM PRECURSOR RNA, and of the diced VGAM118 RNA, herein designated VGAM RNA, and a schematic representation of the secondary folding of VGAM118 folded precursor RNA, herein designated VGAM FOLDED PRECURSOR RNA, of VGAM118 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM118 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 119 (VGAM119) viral gene, which modulates expression of respective host target genes thereof, the function and utility of which host target genes is known in the art.

VGAM119 is a novel bioinformatically detected regulatory, non protein coding, viral micro RNA (miRNA) gene. The method by which VGAM119 was detected is described hereinabove with reference to FIGS. 2-8.

VGAM119 gene, herein designated VGAM GENE, is a viral gene contained in the genome of Vaccinia virus. VGAM119 host target gene, herein designated VGAM HOST TARGET GENE, is a human gene contained in the human genome.

VGAM119 gene, herein designated VGAM GENE, encodes a VGAM119 precursor RNA, herein designated VGAM PRECURSOR RNA. Similar to other miRNA genes, and unlike most ordinary genes, VGAM119 precursor RNA, herein designated VGAM PRECURSOR RNA, does not encode a protein. A nucleotide sequence identical or highly similar to the nucleotide sequence of VGAM119 precursor RNA is designated SEQ ID:105, and is provided hereinbelow with reference to the sequence listing part. Nucleotide sequence SEQ ID: 105 is located at position 52159 relative to the genome of Vaccinia virus.

VGAM119 precursor RNA, herein designated VGAM PRECURSOR RNA, folds onto itself, forming VGAM119 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM119 folded precursor RNA, herein designated VGAM FOLDED PRECURSOR RNA, into VGAM119 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 81%) nucleotide sequence of VGAM119 RNA is designated SEQ ID:454, and is provided hereinbelow with reference to the sequence listing part.

VGAM119 host target gene, herein designated VGAM HOST TARGET GENE, encodes a corresponding messenger RNA, VGAM119 host target RNA, herein designated VGAM HOST TARGET RNA. VGAM119 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM119 RNA, herein designated VGAM RNA, binds complementarily to one or more host target binding sites located in untranslated regions of VGAM119 host target RNA, herein designated VGAM HOST TARGET RNA. This complementary binding is due to the fact that the nucleotide sequence of VGAM119 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM119 RNA, herein designated VGAM RNA, may have a different number of host target binding sites in untranslated regions of a VGAM119 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM119 RNA, herein designated VGAM RNA, to host target binding sites on VGAM119 host target RNA, herein designated VGAM HOST TARGET RNA, such as BINDING SITE I, BINDING SITE II and BINDING SITE III, inhibits translation of VGAM119 host target RNA, herein designated VGAM HOST TARGET RNA, into VGAM119 host target protein, herein designated VGAM HOST TARGET PROTEIN. VGAM host target protein is therefore outlined by a broken line.

It is appreciated that VGAM119 host target gene, herein designated VGAM HOST TARGET GENE, in fact represents a plurality of VGAM119 host target genes. The mRNA of each one of this plurality of VGAM119 host target genes comprises one or more host target binding sites, each having a nucleotide sequence which is at least partly complementary to VGAM119 RNA, herein designated VGAM RNA, and which when bound by VGAM119 RNA, herein designated VGAM RNA, causes inhibition of translation of respective one or more VGAM119 host target proteins.

It is further appreciated by one skilled in the art that the mode of translational inhibition illustrated by FIG. 1 with specific reference to translational inhibition exerted by VGAM119 gene, herein designated VGAM GENE, on one or more VGAM119 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM119 is inhibition of expression of host target genes, as part of a novel viral mechanism of attacking a host. Accordingly, utilities of VGAM119 include diagnosis, prevention and treatment of viral infection by Vaccinia virus. Specific functions, and accordingly utilities, of VGAM119 correlate with, and may be deduced from, the identity of the host target genes which VGAM119 binds and inhibits, and the function of these host target genes, as elaborated hereinbelow.

Nucleotide sequences of the VGAM119 precursor RNA, herein designated VGAM PRECURSOR RNA, and of the diced VGAM119 RNA, herein designated VGAM RNA, and a schematic representation of the secondary folding of VGAM119 folded precursor RNA, herein designated VGAM FOLDED PRECURSOR RNA, of VGAM119 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM119 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 120 (VGAM120) viral gene, which modulates expression of respective host target genes thereof, the function and utility of which host target genes is known in the art.

VGAM120 is a novel bioinformatically detected regulatory, non protein coding, viral micro RNA (miRNA) gene. The method by which VGAM120 was detected is described hereinabove with reference to FIGS. 2-8.

VGAM120 gene, herein designated VGAM GENE, is a viral gene contained in the genome of Vaccinia virus. VGAM120 host target gene, herein designated VGAM HOST TARGET GENE, is a human gene contained in the human genome.

VGAM120 gene, herein designated VGAM GENE, encodes a VGAM120 precursor RNA, herein designated VGAM PRECURSOR RNA. Similar to other miRNA genes, and unlike most ordinary genes, VGAM120 precursor RNA, herein designated VGAM PRECURSOR RNA, does not encode a protein. A nucleotide sequence identical or highly similar to the nucleotide sequence of VGAM120 precursor RNA is designated SEQ ID:106, and is provided hereinbelow with reference to the sequence listing part. Nucleotide sequence SEQ ID: 106 is located at position 50332 relative to the genome of Vaccinia virus.

VGAM120 precursor RNA, herein designated VGAM PRECURSOR RNA, folds onto itself, forming VGAM120 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM120 folded precursor RNA, herein designated VGAM FOLDED PRECURSOR RNA, into VGAM120 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 91%) nucleotide sequence of VGAM120 RNA is designated SEQ ID:455, and is provided hereinbelow with reference to the sequence listing part.

VGAM120 host target gene, herein designated VGAM HOST TARGET GENE, encodes a corresponding messenger RNA, VGAM120 host target RNA, herein designated VGAM HOST TARGET RNA. VGAM120 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM120 RNA, herein designated VGAM RNA, binds complementarily to one or more host target binding sites located in untranslated regions of VGAM120 host target RNA, herein designated VGAM HOST TARGET RNA. This complementary binding is due to the fact that the nucleotide sequence of VGAM120 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM120 RNA, herein designated VGAM RNA, may have a different number of host target binding sites in untranslated regions of a VGAM120 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM120 RNA, herein designated VGAM RNA, to host target binding sites on VGAM120 host target RNA, herein designated VGAM HOST TARGET RNA, such as BINDING SITE I, BINDING SITE II and BINDING SITE III, inhibits translation of VGAM120 host target RNA, herein designated VGAM HOST TARGET RNA, into VGAM120 host target protein, herein designated VGAM HOST TARGET PROTEIN. VGAM host target protein is therefore outlined by a broken line.

It is appreciated that VGAM120 host target gene, herein designated VGAM HOST TARGET GENE, in fact represents a plurality of VGAM120 host target genes. The mRNA of each one of this plurality of VGAM120 host target genes comprises one or more host target binding sites, each having a nucleotide sequence which is at least partly complementary to VGAM120 RNA, herein designated VGAM RNA, and which when bound by VGAM120 RNA, herein designated VGAM RNA, causes inhibition of translation of respective one or more VGAM120 host target proteins.

It is further appreciated by one skilled in the art that the mode of translational inhibition illustrated by FIG. 1 with specific reference to translational inhibition exerted by VGAM120 gene, herein designated VGAM GENE, on one or more VGAM120 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM120 is inhibition of expression of host target genes, as part of a novel viral mechanism of attacking a host. Accordingly, utilities of VGAM120 include diagnosis, prevention and treatment of viral infection by Vaccinia virus. Specific functions, and accordingly utilities, of VGAM120 correlate with, and may be deduced from, the identity of the host target genes which VGAM120 binds and inhibits, and the function of these host target genes, as elaborated hereinbelow.

Nucleotide sequences of the VGAM120 precursor RNA, herein designated VGAM PRECURSOR RNA, and of the diced VGAM120 RNA, herein designated VGAM RNA, and a schematic representation of the secondary folding of VGAM120 folded precursor RNA, herein designated VGAM FOLDED PRECURSOR RNA, of VGAM120 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM120 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 121 (VGAM121) viral gene, which modulates expression of respective host target genes thereof, the function and utility of which host target genes is known in the art.

VGAM121 is a novel bioinformatically detected regulatory, non protein coding, viral micro RNA (miRNA) gene. The method by which VGAM121 was detected is described hereinabove with reference to FIGS. 2-8.

VGAM121 gene, herein designated VGAM GENE, is a viral gene contained in the genome of Vaccinia virus. VGAM121 host target gene, herein designated VGAM HOST TARGET GENE, is a human gene contained in the human genome.

VGAM121 gene, herein designated VGAM GENE, encodes a VGAM121 precursor RNA, herein designated VGAM PRECURSOR RNA. Similar to other miRNA genes, and unlike most ordinary genes, VGAM121 precursor RNA, herein designated VGAM PRECURSOR RNA, does not encode a protein. A nucleotide sequence identical or highly similar to the nucleotide sequence of VGAM121 precursor RNA is designated SEQ ID:107, and is provided hereinbelow with reference to the sequence listing part. Nucleotide sequence SEQ ID: 107 is located at position 47859 relative to the genome of Vaccinia virus.

VGAM121 precursor RNA, herein designated VGAM PRECURSOR RNA, folds onto itself, forming VGAM121 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM121 folded precursor RNA, herein designated VGAM FOLDED PRECURSOR RNA, into VGAM121 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 79%) nucleotide sequence of VGAM121 RNA is designated SEQ ID:456, and is provided hereinbelow with reference to the sequence listing part.

VGAM121 host target gene, herein designated VGAM HOST TARGET GENE, encodes a corresponding messenger RNA, VGAM121 host target RNA, herein designated VGAM HOST TARGET RNA. VGAM121 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM121 RNA, herein designated VGAM RNA, binds complementarily to one or more host target binding sites located in untranslated regions of VGAM121 host target RNA, herein designated VGAM HOST TARGET RNA. This complementary binding is due to the fact that the nucleotide sequence of VGAM121 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM121 RNA, herein designated VGAM RNA, may have a different number of host target binding sites in untranslated regions of a VGAM121 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM121 RNA, herein designated VGAM RNA, to host target binding sites on VGAM121 host target RNA, herein designated VGAM HOST TARGET RNA, such as BINDING SITE I, BINDING SITE II and BINDING SITE III, inhibits translation of VGAM121 host target RNA, herein designated VGAM HOST TARGET RNA, into VGAM121 host target protein, herein designated VGAM HOST TARGET PROTEIN. VGAM host target protein is therefore outlined by a broken line.

It is appreciated that VGAM121 host target gene, herein designated VGAM HOST TARGET GENE, in fact represents a plurality of VGAM121 host target genes. The mRNA of each one of this plurality of VGAM121 host target genes comprises one or more host target binding sites, each having a nucleotide sequence which is at least partly complementary to VGAM121 RNA, herein designated VGAM RNA, and which when bound by VGAM121 RNA, herein designated VGAM RNA, causes inhibition of translation of respective one or more VGAM121 host target proteins.

It is further appreciated by one skilled in the art that the mode of translational inhibition illustrated by FIG. 1 with specific reference to translational inhibition exerted by VGAM121 gene, herein designated VGAM GENE, on one or more VGAM121 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM121 is inhibition of expression of host target genes, as part of a novel viral mechanism of attacking a host. Accordingly, utilities of VGAM121 include diagnosis, prevention and treatment of viral infection by Vaccinia virus. Specific functions, and accordingly utilities, of VGAM121 correlate with, and may be deduced from, the identity of the host target genes which VGAM121 binds and inhibits, and the function of these host target genes, as elaborated hereinbelow.

Nucleotide sequences of the VGAM121 precursor RNA, herein designated VGAM PRECURSOR RNA, and of the diced VGAM121 RNA, herein designated VGAM RNA, and a schematic representation of the secondary folding of VGAM121 folded precursor RNA, herein designated VGAM FOLDED PRECURSOR RNA, of VGAM121 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM121 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 122 (VGAM122) viral gene, which modulates expression of respective host target genes thereof, the function and utility of which host target genes is known in the art.

VGAM122 is a novel bioinformatically detected regulatory, non protein coding, viral micro RNA (miRNA) gene. The method by which VGAM122 was detected is described hereinabove with reference to FIGS. 2-8.

VGAM122 gene, herein designated VGAM GENE, is a viral gene contained in the genome of Vaccinia virus. VGAM122 host target gene, herein designated VGAM HOST TARGET GENE, is a human gene contained in the human genome.

VGAM122 gene, herein designated VGAM GENE, encodes a VGAM122 precursor RNA, herein designated VGAM PRECURSOR RNA. Similar to other miRNA genes, and unlike most ordinary genes, VGAM122 precursor RNA, herein designated VGAM PRECURSOR RNA, does not encode a protein. A nucleotide sequence identical or highly similar to the nucleotide sequence of VGAM122 precursor RNA is designated SEQ ID:108, and is provided hereinbelow with reference to the sequence listing part. Nucleotide sequence SEQ ID: 108 is located at position 50837 relative to the genome of Vaccinia virus.

VGAM122 precursor RNA, herein designated VGAM PRECURSOR RNA, folds onto itself, forming VGAM122 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM122 folded precursor RNA, herein designated VGAM FOLDED PRECURSOR RNA, into VGAM122 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM122 RNA is designated SEQ ID:457, and is provided hereinbelow with reference to the sequence listing part.

VGAM122 host target gene, herein designated VGAM HOST TARGET GENE, encodes a corresponding messenger RNA, VGAM122 host target RNA, herein designated VGAM HOST TARGET RNA. VGAM122 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM122 RNA, herein designated VGAM RNA, binds complementarily to one or more host target binding sites located in untranslated regions of VGAM122 host target RNA, herein designated VGAM HOST TARGET RNA. This complementary binding is due to the fact that the nucleotide sequence of VGAM122 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM122 RNA, herein designated VGAM RNA, may have a different number of host target binding sites in untranslated regions of a VGAM122 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM122 RNA, herein designated VGAM RNA, to host target binding sites on VGAM122 host target RNA, herein designated VGAM HOST TARGET RNA, such as BINDING SITE I, BINDING SITE II and BINDING SITE III, inhibits translation of VGAM122 host target RNA, herein designated VGAM HOST TARGET RNA, into VGAM122 host target protein, herein designated VGAM HOST TARGET PROTEIN. VGAM host target protein is therefore outlined by a broken line.

It is appreciated that VGAM122 host target gene, herein designated VGAM HOST TARGET GENE, in fact represents a plurality of VGAM122 host target genes. The mRNA of each one of this plurality of VGAM122 host target genes comprises one or more host target binding sites, each having a nucleotide sequence which is at least partly complementary to VGAM122 RNA, herein designated VGAM RNA, and which when bound by VGAM122 RNA, herein designated VGAM RNA, causes inhibition of translation of respective one or more VGAM122 host target proteins.

It is further appreciated by one skilled in the art that the mode of translational inhibition illustrated by FIG. 1 with specific reference to translational inhibition exerted by VGAM122 gene, herein designated VGAM GENE, on one or more VGAM122 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM122 is inhibition of expression of host target genes, as part of a novel viral mechanism of attacking a host. Accordingly, utilities of VGAM122 include diagnosis, prevention and treatment of viral infection by Vaccinia virus. Specific functions, and accordingly utilities, of VGAM122 correlate with, and may be deduced from, the identity of the host target genes which VGAM122 binds and inhibits, and the function of these host target genes, as elaborated hereinbelow.

Nucleotide sequences of the VGAM122 precursor RNA, herein designated VGAM PRECURSOR RNA, and of the diced VGAM122 RNA, herein designated VGAM RNA, and a schematic representation of the secondary folding of VGAM122 folded precursor RNA, herein designated VGAM FOLDED PRECURSOR RNA, of VGAM122 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM122 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 123 (VGAM123) viral gene, which modulates expression of respective host target genes thereof, the function and utility of which host target genes is known in the art.

VGAM123 is a novel bioinformatically detected regulatory, non protein coding, viral micro RNA (miRNA) gene. The method by which VGAM123 was detected is described hereinabove with reference to FIGS. 2-8.

VGAM123 gene, herein designated VGAM GENE, is a viral gene contained in the genome of Vaccinia virus. VGAM123 host target gene, herein designated VGAM HOST TARGET GENE, is a human gene contained in the human genome.

VGAM123 gene, herein designated VGAM GENE, encodes a VGAM123 precursor RNA, herein designated VGAM PRECURSOR RNA. Similar to other miRNA genes, and unlike most ordinary genes, VGAM123 precursor RNA, herein designated VGAM PRECURSOR RNA, does not encode a protein. A nucleotide sequence identical or highly similar to the nucleotide sequence of VGAM123 precursor RNA is designated SEQ ID:109, and is provided hereinbelow with reference to the sequence listing part. Nucleotide sequence SEQ ID: 109 is located at position 52454 relative to the genome of Vaccinia virus.

VGAM123 precursor RNA, herein designated VGAM PRECURSOR RNA, folds onto itself, forming VGAM123 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM123 folded precursor RNA, herein designated VGAM FOLDED PRECURSOR RNA, into VGAM123 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 76%) nucleotide sequence of VGAM123 RNA is designated SEQ ID:458, and is provided hereinbelow with reference to the sequence listing part.

VGAM123 host target gene, herein designated VGAM HOST TARGET GENE, encodes a corresponding messenger RNA, VGAM123 host target RNA, herein designated VGAM HOST TARGET RNA. VGAM123 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM123 RNA, herein designated VGAM RNA, binds complementarily to one or more host target binding sites located in untranslated regions of VGAM123 host target RNA, herein designated VGAM HOST TARGET RNA. This complementary binding is due to the fact that the nucleotide sequence of VGAM123 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM123 RNA, herein designated VGAM RNA, may have a different number of host target binding sites in untranslated regions of a VGAM123 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM123 RNA, herein designated VGAM RNA, to host target binding sites on VGAM123 host target RNA, herein designated VGAM HOST TARGET RNA, such as BINDING SITE I, BINDING SITE II and BINDING SITE III, inhibits translation of VGAM123 host target RNA, herein designated VGAM HOST TARGET RNA, into VGAM123 host target protein, herein designated VGAM HOST TARGET PROTEIN. VGAM host target protein is therefore outlined by a broken line.

It is appreciated that VGAM123 host target gene, herein designated VGAM HOST TARGET GENE, in fact represents a plurality of VGAM123 host target genes. The mRNA of each one of this plurality of VGAM123 host target genes comprises one or more host target binding sites, each having a nucleotide sequence which is at least partly complementary to VGAM123 RNA, herein designated VGAM RNA, and which when bound by VGAM123 RNA, herein designated VGAM RNA, causes inhibition of translation of respective one or more VGAM123 host target proteins.

It is further appreciated by one skilled in the art that the mode of translational inhibition illustrated by FIG. 1 with specific reference to translational inhibition exerted by VGAM123 gene, herein designated VGAM GENE, on one or more VGAM123 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM123 is inhibition of expression of host target genes, as part of a novel viral mechanism of attacking a host. Accordingly, utilities of VGAM123 include diagnosis, prevention and treatment of viral infection by Vaccinia virus. Specific functions, and accordingly utilities, of VGAM123 correlate with, and may be deduced from, the identity of the host target genes which VGAM123 binds and inhibits, and the function of these host target genes, as elaborated hereinbelow.

Nucleotide sequences of the VGAM123 precursor RNA, herein designated VGAM PRECURSOR RNA, and of the diced VGAM123 RNA, herein designated VGAM RNA, and a schematic representation of the secondary folding of VGAM123 folded precursor RNA, herein designated VGAM FOLDED PRECURSOR RNA, of VGAM123 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM123 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 124 (VGAM124) viral gene, which modulates expression of respective host target genes thereof, the function and utility of which host target genes is known in the art.

VGAM124 is a novel bioinformatically detected regulatory, non protein coding, viral micro RNA (miRNA) gene. The method by which VGAM124 was detected is described hereinabove with reference to FIGS. 2-8.

VGAM124 gene, herein designated VGAM GENE, is a viral gene contained in the genome of Vaccinia virus. VGAM124 host target gene, herein designated VGAM HOST TARGET GENE, is a human gene contained in the human genome.

VGAM124 gene, herein designated VGAM GENE, encodes a VGAM124 precursor RNA, herein designated VGAM PRECURSOR RNA. Similar to other miRNA genes, and unlike most ordinary genes, VGAM124 precursor RNA, herein designated VGAM PRECURSOR RNA, does not encode a protein. A nucleotide sequence identical or highly similar to the nucleotide sequence of VGAM124 precursor RNA is designated SEQ ID:110, and is provided hereinbelow with reference to the sequence listing part. Nucleotide sequence SEQ ID:110 is located at position 52549 relative to the genome of Vaccinia virus.

VGAM124 precursor RNA, herein designated VGAM PRECURSOR RNA, folds onto itself, forming VGAM124 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM124 folded precursor RNA, herein designated VGAM FOLDED PRECURSOR RNA, into VGAM124 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 77%) nucleotide sequence of VGAM124 RNA is designated SEQ ID:459, and is provided hereinbelow with reference to the sequence listing part.

VGAM124 host target gene, herein designated VGAM HOST TARGET GENE, encodes a corresponding messenger RNA, VGAM124 host target RNA, herein designated VGAM HOST TARGET RNA. VGAM124 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM124 RNA, herein designated VGAM RNA, binds complementarily to one or more host target binding sites located in untranslated regions of VGAM124 host target RNA, herein designated VGAM HOST TARGET RNA. This complementary binding is due to the fact that the nucleotide sequence of VGAM124 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM124 RNA, herein designated VGAM RNA, may have a different number of host target binding sites in untranslated regions of a VGAM124 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM124 RNA, herein designated VGAM RNA, to host target binding sites on VGAM124 host target RNA, herein designated VGAM HOST TARGET RNA, such as BINDING SITE I, BINDING SITE II and BINDING SITE III, inhibits translation of VGAM124 host target RNA, herein designated VGAM HOST TARGET RNA, into VGAM124 host target protein, herein designated VGAM HOST TARGET PROTEIN. VGAM host target protein is therefore outlined by a broken line.

It is appreciated that VGAM124 host target gene, herein designated VGAM HOST TARGET GENE, in fact represents a plurality of VGAM124 host target genes. The mRNA of each one of this plurality of VGAM124 host target genes comprises one or more host target binding sites, each having a nucleotide sequence which is at least partly complementary to VGAM124 RNA, herein designated VGAM RNA, and which when bound by VGAM124 RNA, herein designated VGAM RNA, causes inhibition of translation of respective one or more VGAM124 host target proteins.

It is further appreciated by one skilled in the art that the mode of translational inhibition illustrated by FIG. 1 with specific reference to translational inhibition exerted by VGAM124 gene, herein designated VGAM GENE, on one or more VGAM124 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM124 is inhibition of expression of host target genes, as part of a novel viral mechanism of attacking a host. Accordingly, utilities of VGAM124 include diagnosis, prevention and treatment of viral infection by Vaccinia virus. Specific functions, and accordingly utilities, of VGAM124 correlate with, and may be deduced from, the identity of the host target genes which VGAM124 binds and inhibits, and the function of these host target genes, as elaborated hereinbelow.

Nucleotide sequences of the VGAM124 precursor RNA, herein designated VGAM PRECURSOR RNA, and of the diced VGAM124 RNA, herein designated VGAM RNA, and a schematic representation of the secondary folding of VGAM124 folded precursor RNA, herein designated VGAM FOLDED PRECURSOR RNA, of VGAM124 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM124 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 125 (VGAM125) viral gene, which modulates expression of respective host target genes thereof, the function and utility of which host target genes is known in the art.

VGAM125 is a novel bioinformatically detected regulatory, non protein coding, viral micro RNA (miRNA) gene. The method by which VGAM125 was detected is described hereinabove with reference to FIGS. 2-8.

VGAM125 gene, herein designated VGAM GENE, is a viral gene contained in the genome of Vaccinia virus. VGAM125 host target gene, herein designated VGAM HOST TARGET GENE, is a human gene contained in the human genome.

VGAM125 gene, herein designated VGAM GENE, encodes a VGAM125 precursor RNA, herein designated VGAM PRECURSOR RNA. Similar to other miRNA genes, and unlike most ordinary genes, VGAM125 precursor RNA, herein designated VGAM PRECURSOR RNA, does not encode a protein. A nucleotide sequence identical or highly similar to the nucleotide sequence of VGAM125 precursor RNA is designated SEQ ID: 111, and is provided hereinbelow with reference to the sequence listing part. Nucleotide sequence SEQ ID:111 is located at position 55395 relative to the genome of Vaccinia virus.

VGAM125 precursor RNA, herein designated VGAM PRECURSOR RNA, folds onto itself, forming VGAM125 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM125 folded precursor RNA, herein designated VGAM FOLDED PRECURSOR RNA, into VGAM125 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 91%) nucleotide sequence of VGAM125 RNA is designated SEQ ID:460, and is provided hereinbelow with reference to the sequence listing part.

VGAM125 host target gene, herein designated VGAM HOST TARGET GENE, encodes a corresponding messenger RNA, VGAM125 host target RNA, herein designated VGAM HOST TARGET RNA. VGAM125 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM125 RNA, herein designated VGAM RNA, binds complementarily to one or more host target binding sites located in untranslated regions of VGAM125 host target RNA, herein designated VGAM HOST TARGET RNA. This complementary binding is due to the fact that the nucleotide sequence of VGAM125 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM125 RNA, herein designated VGAM RNA, may have a different number of host target binding sites in untranslated regions of a VGAM125 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM125 RNA, herein designated VGAM RNA, to host target binding sites on VGAM125 host target RNA, herein designated VGAM HOST TARGET RNA, such as BINDING SITE I, BINDING SITE II and BINDING SITE III, inhibits translation of VGAM125 host target RNA, herein designated VGAM HOST TARGET RNA, into VGAM125 host target protein, herein designated VGAM HOST TARGET PROTEIN. VGAM host target protein is therefore outlined by a broken line.

It is appreciated that VGAM125 host target gene, herein designated VGAM HOST TARGET GENE, in fact represents a plurality of VGAM125 host target genes. The mRNA of each one of this plurality of VGAM125 host target genes comprises one or more host target binding sites, each having a nucleotide sequence which is at least partly complementary to VGAM125 RNA, herein designated VGAM RNA, and which when bound by VGAM125 RNA, herein designated VGAM RNA, causes inhibition of translation of respective one or more VGAM125 host target proteins.

It is further appreciated by one skilled in the art that the mode of translational inhibition illustrated by FIG. 1 with specific reference to translational inhibition exerted by VGAM125 gene, herein designated VGAM GENE, on one or more VGAM125 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM125 is inhibition of expression of host target genes, as part of a novel viral mechanism of attacking a host. Accordingly, utilities of VGAM125 include diagnosis, prevention and treatment of viral infection by Vaccinia virus. Specific functions, and accordingly utilities, of VGAM125 correlate with, and may be deduced from, the identity of the host target genes which VGAM125 binds and inhibits, and the function of these host target genes, as elaborated hereinbelow.

Nucleotide sequences of the VGAM125 precursor RNA, herein designated VGAM PRECURSOR RNA, and of the diced VGAM125 RNA, herein designated VGAM RNA, and a schematic representation of the secondary folding of VGAM125 folded precursor RNA, herein designated VGAM FOLDED PRECURSOR RNA, of VGAM125 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM125 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 126 (VGAM126) viral gene, which modulates expression of respective host target genes thereof, the function and utility of which host target genes is known in the art.

VGAM126 is a novel bioinformatically detected regulatory, non protein coding, viral micro RNA (miRNA) gene. The method by which VGAM126 was detected is described hereinabove with reference to FIGS. 2-8.

VGAM126 gene, herein designated VGAM GENE, is a viral gene contained in the genome of Vaccinia virus. VGAM126 host target gene, herein designated VGAM HOST TARGET GENE, is a human gene contained in the human genome.

VGAM126 gene, herein designated VGAM GENE, encodes a VGAM126 precursor RNA, herein designated VGAM PRECURSOR RNA. Similar to other miRNA genes, and unlike most ordinary genes, VGAM126 precursor RNA, herein designated VGAM PRECURSOR RNA, does not encode a protein. A nucleotide sequence identical or highly similar to the nucleotide sequence of VGAM126 precursor RNA is designated SEQ ID:112, and is provided hereinbelow with reference to the sequence listing part. Nucleotide sequence SEQ ID:112 is located at position 53786 relative to the genome of Vaccinia virus.

VGAM126 precursor RNA, herein designated VGAM PRECURSOR RNA, folds onto itself, forming VGAM126 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM126 folded precursor RNA, herein designated VGAM FOLDED PRECURSOR RNA, into VGAM126 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 89%) nucleotide sequence of VGAM126 RNA is designated SEQ ID:461, and is provided hereinbelow with reference to the sequence listing part.

VGAM126 host target gene, herein designated VGAM HOST TARGET GENE, encodes a corresponding messenger RNA, VGAM126 host target RNA, herein designated VGAM HOST TARGET RNA. VGAM126 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM126 RNA, herein designated VGAM RNA, binds complementarily to one or more host target binding sites located in untranslated regions of VGAM126 host target RNA, herein designated VGAM HOST TARGET RNA. This complementary binding is due to the fact that the nucleotide sequence of VGAM126 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM126 RNA, herein designated VGAM RNA, may have a different number of host target binding sites in untranslated regions of a VGAM126 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM126 RNA, herein designated VGAM RNA, to host target binding sites on VGAM126 host target RNA, herein designated VGAM HOST TARGET RNA, such as BINDING SITE I, BINDING SITE II and BINDING SITE III, inhibits translation of VGAM126 host target RNA, herein designated VGAM HOST TARGET RNA, into VGAM126 host target protein, herein designated VGAM HOST TARGET PROTEIN. VGAM host target protein is therefore outlined by a broken line.

It is appreciated that VGAM126 host target gene, herein designated VGAM HOST TARGET GENE, in fact represents a plurality of VGAM126 host target genes. The mRNA of each one of this plurality of VGAM126 host target genes comprises one or more host target binding sites, each having a nucleotide sequence which is at least partly complementary to VGAM126 RNA, herein designated VGAM RNA, and which when bound by VGAM126 RNA, herein designated VGAM RNA, causes inhibition of translation of respective one or more VGAM126 host target proteins.

It is further appreciated by one skilled in the art that the mode of translational inhibition illustrated by FIG. 1 with specific reference to translational inhibition exerted by VGAM126 gene, herein designated VGAM GENE, on one or more VGAM126 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM126 is inhibition of expression of host target genes, as part of a novel viral mechanism of attacking a host. Accordingly, utilities of VGAM126 include diagnosis, prevention and treatment of viral infection by Vaccinia virus. Specific functions, and accordingly utilities, of VGAM126 correlate with, and may be deduced from, the identity of the host target genes which VGAM126 binds and inhibits, and the function of these host target genes, as elaborated hereinbelow.

Nucleotide sequences of the VGAM126 precursor RNA, herein designated VGAM PRECURSOR RNA, and of the diced VGAM126 RNA, herein designated VGAM RNA, and a schematic representation of the secondary folding of VGAM126 folded precursor RNA, herein designated VGAM FOLDED PRECURSOR RNA, of VGAM126 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM126 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 127 (VGAM127) viral gene, which modulates expression of respective host target genes thereof, the function and utility of which host target genes is known in the art.

VGAM127 is a novel bioinformatically detected regulatory, non protein coding, viral micro RNA (miRNA) gene. The method by which VGAM127 was detected is described hereinabove with reference to FIGS. 2-8.

VGAM127 gene, herein designated VGAM GENE, is a viral gene contained in the genome of Vaccinia virus. VGAM127 host target gene, herein designated VGAM HOST TARGET GENE, is a human gene contained in the human genome.

VGAM127 gene, herein designated VGAM GENE, encodes a VGAM127 precursor RNA, herein designated VGAM PRECURSOR RNA. Similar to other miRNA genes, and unlike most ordinary genes, VGAM127 precursor RNA, herein designated VGAM PRECURSOR RNA, does not encode a protein. A nucleotide sequence identical or highly similar to the nucleotide sequence of VGAM127 precursor RNA is designated SEQ ID:113, and is provided hereinbelow with reference to the sequence listing part. Nucleotide sequence SEQ ID:113 is located at position 56050 relative to the genome of Vaccinia virus.

VGAM127 precursor RNA, herein designated VGAM PRECURSOR RNA, folds onto itself, forming VGAM127 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM127 folded precursor RNA, herein designated VGAM FOLDED PRECURSOR RNA, into VGAM127 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM127 RNA is designated SEQ ID:462, and is provided hereinbelow with reference to the sequence listing part.

VGAM127 host target gene, herein designated VGAM HOST TARGET GENE, encodes a corresponding messenger RNA, VGAM127 host target RNA, herein designated VGAM HOST TARGET RNA. VGAM127 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM127 RNA, herein designated VGAM RNA, binds complementarily to one or more host target binding sites located in untranslated regions of VGAM127 host target RNA, herein designated VGAM HOST TARGET RNA. This complementary binding is due to the fact that the nucleotide sequence of VGAM127 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM127 RNA, herein designated VGAM RNA, may have a different number of host target binding sites in untranslated regions of a VGAM127 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM127 RNA, herein designated VGAM RNA, to host target binding sites on VGAM127 host target RNA, herein designated VGAM HOST TARGET RNA, such as BINDING SITE I, BINDING SITE II and BINDING SITE III, inhibits translation of VGAM127 host target RNA, herein designated VGAM HOST TARGET RNA, into VGAM127 host target protein, herein designated VGAM HOST TARGET PROTEIN. VGAM host target protein is therefore outlined by a broken line.

It is appreciated that VGAM127 host target gene, herein designated VGAM HOST TARGET GENE, in fact represents a plurality of VGAM127 host target genes. The mRNA of each one of this plurality of VGAM127 host target genes comprises one or more host target binding sites, each having a nucleotide sequence which is at least partly complementary to VGAM127 RNA, herein designated VGAM RNA, and which when bound by VGAM127 RNA, herein designated VGAM RNA, causes inhibition of translation of respective one or more VGAM127 host target proteins.

It is further appreciated by one skilled in the art that the mode of translational inhibition illustrated by FIG. 1 with specific reference to translational inhibition exerted by VGAM127 gene, herein designated VGAM GENE, on one or more VGAM127 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM127 is inhibition of expression of host target genes, as part of a novel viral mechanism of attacking a host. Accordingly, utilities of VGAM127 include diagnosis, prevention and treatment of viral infection by Vaccinia virus. Specific functions, and accordingly utilities, of VGAM127 correlate with, and may be deduced from, the identity of the host target genes which VGAM127 binds and inhibits, and the function of these host target genes, as elaborated hereinbelow.

Nucleotide sequences of the VGAM127 precursor RNA, herein designated VGAM PRECURSOR RNA, and of the diced VGAM127 RNA, herein designated VGAM RNA, and a schematic representation of the secondary folding of VGAM127 folded precursor RNA, herein designated VGAM FOLDED PRECURSOR RNA, of VGAM127 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM127 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 128 (VGAM128) viral gene, which modulates expression of respective host target genes thereof, the function and utility of which host target genes is known in the art.

VGAM128 is a novel bioinformatically detected regulatory, non protein coding, viral micro RNA (miRNA) gene. The method by which VGAM128 was detected is described hereinabove with reference to FIGS. 2-8.

VGAM128 gene, herein designated VGAM GENE, is a viral gene contained in the genome of Vaccinia virus. VGAM128 host target gene, herein designated VGAM HOST TARGET GENE, is a human gene contained in the human genome.

VGAM128 gene, herein designated VGAM GENE, encodes a VGAM128 precursor RNA, herein designated VGAM PRECURSOR RNA. Similar to other miRNA genes, and unlike most ordinary genes, VGAM128 precursor RNA, herein designated VGAM PRECURSOR RNA, does not encode a protein. A nucleotide sequence identical or highly similar to the nucleotide sequence of VGAM128 precursor RNA is designated SEQ ID:114, and is provided hereinbelow with reference to the sequence listing part. Nucleotide sequence SEQ ID:114 is located at position 55816 relative to the genome of Vaccinia virus.

VGAM128 precursor RNA, herein designated VGAM PRECURSOR RNA, folds onto itself, forming VGAM128 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM128 folded precursor RNA, herein designated VGAM FOLDED PRECURSOR RNA, into VGAM128 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 93%) nucleotide sequence of VGAM128 RNA is designated SEQ ID:463, and is provided hereinbelow with reference to the sequence listing part.

VGAM128 host target gene, herein designated VGAM HOST TARGET GENE, encodes a corresponding messenger RNA, VGAM128 host target RNA, herein designated VGAM HOST TARGET RNA. VGAM128 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM128 RNA, herein designated VGAM RNA, binds complementarily to one or more host target binding sites located in untranslated regions of VGAM128 host target RNA, herein designated VGAM HOST TARGET RNA. This complementary binding is due to the fact that the nucleotide sequence of VGAM128 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM128 RNA, herein designated VGAM RNA, may have a different number of host target binding sites in untranslated regions of a VGAM128 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM128 RNA, herein designated VGAM RNA, to host target binding sites on VGAM128 host target RNA, herein designated VGAM HOST TARGET RNA, such as BINDING SITE I, BINDING SITE II and BINDING SITE III, inhibits translation of VGAM128 host target RNA, herein designated VGAM HOST TARGET RNA, into VGAM128 host target protein, herein designated VGAM HOST TARGET PROTEIN. VGAM host target protein is therefore outlined by a broken line.

It is appreciated that VGAM128 host target gene, herein designated VGAM HOST TARGET GENE, in fact represents a plurality of VGAM128 host target genes. The mRNA of each one of this plurality of VGAM128 host target genes comprises one or more host target binding sites, each having a nucleotide sequence which is at least partly complementary to VGAM128 RNA, herein designated VGAM RNA, and which when bound by VGAM128 RNA, herein designated VGAM RNA, causes inhibition of translation of respective one or more VGAM128 host target proteins.

It is further appreciated by one skilled in the art that the mode of translational inhibition illustrated by FIG. 1 with specific reference to translational inhibition exerted by VGAM128 gene, herein designated VGAM GENE, on one or more VGAM128 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM128 is inhibition of expression of host target genes, as part of a novel viral mechanism of attacking a host. Accordingly, utilities of VGAM128 include diagnosis, prevention and treatment of viral infection by Vaccinia virus. Specific functions, and accordingly utilities, of VGAM128 correlate with, and may be deduced from, the identity of the host target genes which VGAM128 binds and inhibits, and the function of these host target genes, as elaborated hereinbelow.

Nucleotide sequences of the VGAM128 precursor RNA, herein designated VGAM PRECURSOR RNA, and of the diced VGAM128 RNA, herein designated VGAM RNA, and a schematic representation of the secondary folding of VGAM128 folded precursor RNA, herein designated VGAM FOLDED PRECURSOR RNA, of VGAM128 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM128 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 129 (VGAM129) viral gene, which modulates expression of respective host target genes thereof, the function and utility of which host target genes is known in the art.

VGAM129 is a novel bioinformatically detected regulatory, non protein coding, viral micro RNA (miRNA) gene. The method by which VGAM129 was detected is described hereinabove with reference to FIGS. 2-8.

VGAM129 gene, herein designated VGAM GENE, is a viral gene contained in the genome of Vaccinia virus. VGAM129 host target gene, herein designated VGAM HOST TARGET GENE, is a human gene contained in the human genome.

VGAM129 gene, herein designated VGAM GENE, encodes a VGAM129 precursor RNA, herein designated VGAM PRECURSOR RNA. Similar to other miRNA genes, and unlike most ordinary genes, VGAM129 precursor RNA, herein designated VGAM PRECURSOR RNA, does not encode a protein. A nucleotide sequence identical or highly similar to the nucleotide sequence of VGAM129 precursor RNA is designated SEQ ID:115, and is provided hereinbelow with reference to the sequence listing part. Nucleotide sequence SEQ ID:115 is located at position 57776 relative to the genome of Vaccinia virus.

VGAM129 precursor RNA, herein designated VGAM PRECURSOR RNA, folds onto itself, forming VGAM129 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM129 folded precursor RNA, herein designated VGAM FOLDED PRECURSOR RNA, into VGAM129 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 76%) nucleotide sequence of VGAM129 RNA is designated SEQ ID:464, and is provided hereinbelow with reference to the sequence listing part.

VGAM129 host target gene, herein designated VGAM HOST TARGET GENE, encodes a corresponding messenger RNA, VGAM129 host target RNA, herein designated VGAM HOST TARGET RNA. VGAM129 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM129 RNA, herein designated VGAM RNA, binds complementarily to one or more host target binding sites located in untranslated regions of VGAM129 host target RNA, herein designated VGAM HOST TARGET RNA. This complementary binding is due to the fact that the nucleotide sequence of VGAM129 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM129 RNA, herein designated VGAM RNA, may have a different number of host target binding sites in untranslated regions of a VGAM129 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM129 RNA, herein designated VGAM RNA, to host target binding sites on VGAM129 host target RNA, herein designated VGAM HOST TARGET RNA, such as BINDING SITE I, BINDING SITE II and BINDING SITE III, inhibits translation of VGAM129 host target RNA, herein designated VGAM HOST TARGET RNA, into VGAM129 host target protein, herein designated VGAM HOST TARGET PROTEIN. VGAM host target protein is therefore outlined by a broken line.

It is appreciated that VGAM129 host target gene, herein designated VGAM HOST TARGET GENE, in fact represents a plurality of VGAM129 host target genes. The mRNA of each one of this plurality of VGAM129 host target genes comprises one or more host target binding sites, each having a nucleotide sequence which is at least partly complementary to VGAM129 RNA, herein designated VGAM RNA, and which when bound by VGAM129 RNA, herein designated VGAM RNA, causes inhibition of translation of respective one or more VGAM129 host target proteins.

It is further appreciated by one skilled in the art that the mode of translational inhibition illustrated by FIG. 1 with specific reference to translational inhibition exerted by VGAM129 gene, herein designated VGAM GENE, on one or more VGAM129 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM129 is inhibition of expression of host target genes, as part of a novel viral mechanism of attacking a host. Accordingly, utilities of VGAM129 include diagnosis, prevention and treatment of viral infection by Vaccinia virus. Specific functions, and accordingly utilities, of VGAM129 correlate with, and may be deduced from, the identity of the host target genes which VGAM129 binds and inhibits, and the function of these host target genes, as elaborated hereinbelow.

Nucleotide sequences of the VGAM129 precursor RNA, herein designated VGAM PRECURSOR RNA, and of the diced VGAM129 RNA, herein designated VGAM RNA, and a schematic representation of the secondary folding of VGAM129 folded precursor RNA, herein designated VGAM FOLDED PRECURSOR RNA, of VGAM129 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM129 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 130 (VGAM130) viral gene, which modulates expression of respective host target genes thereof, the function and utility of which host target genes is known in the art.

VGAM130 is a novel bioinformatically detected regulatory, non protein coding, viral micro RNA (miRNA) gene. The method by which VGAM130 was detected is described hereinabove with reference to FIGS. 2-8.

VGAM130 gene, herein designated VGAM GENE, is a viral gene contained in the genome of Vaccinia virus. VGAM130 host target gene, herein designated VGAM HOST TARGET GENE, is a human gene contained in the human genome.

VGAM130 gene, herein designated VGAM GENE, encodes a VGAM130 precursor RNA, herein designated VGAM PRECURSOR RNA. Similar to other miRNA genes, and unlike most ordinary genes, VGAM130 precursor RNA, herein designated VGAM PRECURSOR RNA, does not encode a protein. A nucleotide sequence identical or highly similar to the nucleotide sequence of VGAM130 precursor RNA is designated SEQ ID:116, and is provided hereinbelow with reference to the sequence listing part. Nucleotide sequence SEQ ID:116 is located at position 60133 relative to the genome of Vaccinia virus.

VGAM130 precursor RNA, herein designated VGAM PRECURSOR RNA, folds onto itself, forming VGAM130 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM130 folded precursor RNA, herein designated VGAM FOLDED PRECURSOR RNA, into VGAM130 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM130 RNA is designated SEQ ID:465, and is provided hereinbelow with reference to the sequence listing part.

VGAM130 host target gene, herein designated VGAM HOST TARGET GENE, encodes a corresponding messenger RNA, VGAM130 host target RNA, herein designated VGAM HOST TARGET RNA. VGAM130 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM130 RNA, herein designated VGAM RNA, binds complementarily to one or more host target binding sites located in untranslated regions of VGAM130 host target RNA, herein designated VGAM HOST TARGET RNA. This complementary binding is due to the fact that the nucleotide sequence of VGAM130 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM130 RNA, herein designated VGAM RNA, may have a different number of host target binding sites in untranslated regions of a VGAM130 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM130 RNA, herein designated VGAM RNA, to host target binding sites on VGAM130 host target RNA, herein designated VGAM HOST TARGET RNA, such as BINDING SITE I, BINDING SITE II and BINDING SITE III, inhibits translation of VGAM130 host target RNA, herein designated VGAM HOST TARGET RNA, into VGAM130 host target protein, herein designated VGAM HOST TARGET PROTEIN. VGAM host target protein is therefore outlined by a broken line.

It is appreciated that VGAM130 host target gene, herein designated VGAM HOST TARGET GENE, in fact represents a plurality of VGAM130 host target genes. The mRNA of each one of this plurality of VGAM130 host target genes comprises one or more host target binding sites, each having a nucleotide sequence which is at least partly complementary to VGAM130 RNA, herein designated VGAM RNA, and which when bound by VGAM130 RNA, herein designated VGAM RNA, causes inhibition of translation of respective one or more VGAM130 host target proteins.

It is further appreciated by one skilled in the art that the mode of translational inhibition illustrated by FIG. 1 with specific reference to translational inhibition exerted by VGAM130 gene, herein designated VGAM GENE, on one or more VGAM130 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM130 is inhibition of expression of host target genes, as part of a novel viral mechanism of attacking a host. Accordingly, utilities of VGAM130 include diagnosis, prevention and treatment of viral infection by Vaccinia virus. Specific functions, and accordingly utilities, of VGAM130 correlate with, and may be deduced from, the identity of the host target genes which VGAM130 binds and inhibits, and the function of these host target genes, as elaborated hereinbelow.

Nucleotide sequences of the VGAM130 precursor RNA, herein designated VGAM PRECURSOR RNA, and of the diced VGAM130 RNA, herein designated VGAM RNA, and a schematic representation of the secondary folding of VGAM130 folded precursor RNA, herein designated VGAM FOLDED PRECURSOR RNA, of VGAM130 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM130 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 131 (VGAM131) viral gene, which modulates expression of respective host target genes thereof, the function and utility of which host target genes is known in the art.

VGAM131 is a novel bioinformatically detected regulatory, non protein coding, viral micro RNA (miRNA) gene. The method by which VGAM131 was detected is described hereinabove with reference to FIGS. 2-8.

VGAM131 gene, herein designated VGAM GENE, is a viral gene contained in the genome of Vaccinia virus. VGAM131 host target gene, herein designated VGAM HOST TARGET GENE, is a human gene contained in the human genome.

VGAM131 gene, herein designated VGAM GENE, encodes a VGAM131 precursor RNA, herein designated VGAM PRECURSOR RNA. Similar to other miRNA genes, and unlike most ordinary genes, VGAM131 precursor RNA, herein designated VGAM PRECURSOR RNA, does not encode a protein. A nucleotide sequence identical or highly similar to the nucleotide sequence of VGAM131 precursor RNA is designated SEQ ID:117, and is provided hereinbelow with reference to the sequence listing part. Nucleotide sequence SEQ ID:117 is located at position 60496 relative to the genome of Vaccinia virus.

VGAM131 precursor RNA, herein designated VGAM PRECURSOR RNA, folds onto itself, forming VGAM131 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM131 folded precursor RNA, herein designated VGAM FOLDED PRECURSOR RNA, into VGAM131 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 89%) nucleotide sequence of VGAM131 RNA is designated SEQ ID:466, and is provided hereinbelow with reference to the sequence listing part.

VGAM131 host target gene, herein designated VGAM HOST TARGET GENE, encodes a corresponding messenger RNA, VGAM131 host target RNA, herein designated VGAM HOST TARGET RNA. VGAM131 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM131 RNA, herein designated VGAM RNA, binds complementarily to one or more host target binding sites located in untranslated regions of VGAM131 host target RNA, herein designated VGAM HOST TARGET RNA. This complementary binding is due to the fact that the nucleotide sequence of VGAM131 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM131 RNA, herein designated VGAM RNA, may have a different number of host target binding sites in untranslated regions of a VGAM131 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM131 RNA, herein designated VGAM RNA, to host target binding sites on VGAM131 host target RNA, herein designated VGAM HOST TARGET RNA, such as BINDING SITE I, BINDING SITE II and BINDING SITE III, inhibits translation of VGAM131 host target RNA, herein designated VGAM HOST TARGET RNA, into VGAM131 host target protein, herein designated VGAM HOST TARGET PROTEIN. VGAM host target protein is therefore outlined by a broken line.

It is appreciated that VGAM131 host target gene, herein designated VGAM HOST TARGET GENE, in fact represents a plurality of VGAM131 host target genes. The mRNA of each one of this plurality of VGAM131 host target genes comprises one or more host target binding sites, each having a nucleotide sequence which is at least partly complementary to VGAM131 RNA, herein designated VGAM RNA, and which when bound by VGAM131 RNA, herein designated VGAM RNA, causes inhibition of translation of respective one or more VGAM131 host target proteins.

It is further appreciated by one skilled in the art that the mode of translational inhibition illustrated by FIG. 1 with specific reference to translational inhibition exerted by VGAM131 gene, herein designated VGAM GENE, on one or more VGAM131 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM131 is inhibition of expression of host target genes, as part of a novel viral mechanism of attacking a host. Accordingly, utilities of VGAM131 include diagnosis, prevention and treatment of viral infection by Vaccinia virus. Specific functions, and accordingly utilities, of VGAM131 correlate with, and may be deduced from, the identity of the host target genes which VGAM131 binds and inhibits, and the function of these host target genes, as elaborated hereinbelow.

Nucleotide sequences of the VGAM131 precursor RNA, herein designated VGAM PRECURSOR RNA, and of the diced VGAM131 RNA, herein designated VGAM RNA, and a schematic representation of the secondary folding of VGAM131 folded precursor RNA, herein designated VGAM FOLDED PRECURSOR RNA, of VGAM131 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM131 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 132 (VGAM132) viral gene, which modulates expression of respective host target genes thereof, the function and utility of which host target genes is known in the art.

VGAM132 is a novel bioinformatically detected regulatory, non protein coding, viral micro RNA (miRNA) gene. The method by which VGAM132 was detected is described hereinabove with reference to FIGS. 2-8.

VGAM132 gene, herein designated VGAM GENE, is a viral gene contained in the genome of Vaccinia virus. VGAM132 host target gene, herein designated VGAM HOST TARGET GENE, is a human gene contained in the human genome.

VGAM132 gene, herein designated VGAM GENE, encodes a VGAM132 precursor RNA, herein designated VGAM PRECURSOR RNA. Similar to other miRNA genes, and unlike most ordinary genes, VGAM132 precursor RNA, herein designated VGAM PRECURSOR RNA, does not encode a protein. A nucleotide sequence identical or highly similar to the nucleotide sequence of VGAM132 precursor RNA is designated SEQ ID:118, and is provided hereinbelow with reference to the sequence listing part. Nucleotide sequence SEQ ID:118 is located at position 60420 relative to the genome of Vaccinia virus.

VGAM132 precursor RNA, herein designated VGAM PRECURSOR RNA, folds onto itself, forming VGAM132 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM132 folded precursor RNA, herein designated VGAM FOLDED PRECURSOR RNA, into VGAM132 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 71%) nucleotide sequence of VGAM132 RNA is designated SEQ ID:467, and is provided hereinbelow with reference to the sequence listing part.

VGAM132 host target gene, herein designated VGAM HOST TARGET GENE, encodes a corresponding messenger RNA, VGAM132 host target RNA, herein designated VGAM HOST TARGET RNA. VGAM132 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM132 RNA, herein designated VGAM RNA, binds complementarily to one or more host target binding sites located in untranslated regions of VGAM132 host target RNA, herein designated VGAM HOST TARGET RNA. This complementary binding is due to the fact that the nucleotide sequence of VGAM132 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM132 RNA, herein designated VGAM RNA, may have a different number of host target binding sites in untranslated regions of a VGAM132 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM132 RNA, herein designated VGAM RNA, to host target binding sites on VGAM132 host target RNA, herein designated VGAM HOST TARGET RNA, such as BINDING SITE I, BINDING SITE II and BINDING SITE III, inhibits translation of VGAM132 host target RNA, herein designated VGAM HOST TARGET RNA, into VGAM132 host target protein, herein designated VGAM HOST TARGET PROTEIN. VGAM host target protein is therefore outlined by a broken line.

It is appreciated that VGAM132 host target gene, herein designated VGAM HOST TARGET GENE, in fact represents a plurality of VGAM132 host target genes. The mRNA of each one of this plurality of VGAM132 host target genes comprises one or more host target binding sites, each having a nucleotide sequence which is at least partly complementary to VGAM132 RNA, herein designated VGAM RNA, and which when bound by VGAM132 RNA, herein designated VGAM RNA, causes inhibition of translation of respective one or more VGAM132 host target proteins.

It is further appreciated by one skilled in the art that the mode of translational inhibition illustrated by FIG. 1 with specific reference to translational inhibition exerted by VGAM132 gene, herein designated VGAM GENE, on one or more VGAM132 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM132 is inhibition of expression of host target genes, as part of a novel viral mechanism of attacking a host. Accordingly, utilities of VGAM132 include diagnosis, prevention and treatment of viral infection by Vaccinia virus. Specific functions, and accordingly utilities, of VGAM132 correlate with, and may be deduced from, the identity of the host target genes which VGAM132 binds and inhibits, and the function of these host target genes, as elaborated hereinbelow.

Nucleotide sequences of the VGAM132 precursor RNA, herein designated VGAM PRECURSOR RNA, and of the diced VGAM132 RNA, herein designated VGAM RNA, and a schematic representation of the secondary folding of VGAM132 folded precursor RNA, herein designated VGAM FOLDED PRECURSOR RNA, of VGAM132 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM132 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 133 (VGAM133) viral gene, which modulates expression of respective host target genes thereof, the function and utility of which host target genes is known in the art.

VGAM133 is a novel bioinformatically detected regulatory, non protein coding, viral micro RNA (miRNA) gene. The method by which VGAM133 was detected is described hereinabove with reference to FIGS. 2-8.

VGAM133 gene, herein designated VGAM GENE, is a viral gene contained in the genome of Vaccinia virus. VGAM133 host target gene, herein designated VGAM HOST TARGET GENE, is a human gene contained in the human genome.

VGAM133 gene, herein designated VGAM GENE, encodes a VGAM133 precursor RNA, herein designated VGAM PRECURSOR RNA. Similar to other miRNA genes, and unlike most ordinary genes, VGAM133 precursor RNA, herein designated VGAM PRECURSOR RNA, does not encode a protein. A nucleotide sequence identical or highly similar to the nucleotide sequence of VGAM133 precursor RNA is designated SEQ ID:119, and is provided hereinbelow with reference to the sequence listing part. Nucleotide sequence SEQ ID:119 is located at position 62117 relative to the genome of Vaccinia virus.

VGAM133 precursor RNA, herein designated VGAM PRECURSOR RNA, folds onto itself, forming VGAM133 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM133 folded precursor RNA, herein designated VGAM FOLDED PRECURSOR RNA, into VGAM133 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 72%) nucleotide sequence of VGAM133 RNA is designated SEQ ID:468, and is provided hereinbelow with reference to the sequence listing part.

VGAM133 host target gene, herein designated VGAM HOST TARGET GENE, encodes a corresponding messenger RNA, VGAM133 host target RNA, herein designated VGAM HOST TARGET RNA. VGAM133 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM133 RNA, herein designated VGAM RNA, binds complementarily to one or more host target binding sites located in untranslated regions of VGAM133 host target RNA, herein designated VGAM HOST TARGET RNA. This complementary binding is due to the fact that the nucleotide sequence of VGAM133 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM133 RNA, herein designated VGAM RNA, may have a different number of host target binding sites in untranslated regions of a VGAM133 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM133 RNA, herein designated VGAM RNA, to host target binding sites on VGAM133 host target RNA, herein designated VGAM HOST TARGET RNA, such as BINDING SITE I, BINDING SITE II and BINDING SITE III, inhibits translation of VGAM133 host target RNA, herein designated VGAM HOST TARGET RNA, into VGAM133 host target protein, herein designated VGAM HOST TARGET PROTEIN. VGAM host target protein is therefore outlined by a broken line.

It is appreciated that VGAM133 host target gene, herein designated VGAM HOST TARGET GENE, in fact represents a plurality of VGAM133 host target genes. The mRNA of each one of this plurality of VGAM133 host target genes comprises one or more host target binding sites, each having a nucleotide sequence which is at least partly complementary to VGAM133 RNA, herein designated VGAM RNA, and which when bound by VGAM133 RNA, herein designated VGAM RNA, causes inhibition of translation of respective one or more VGAM133 host target proteins.

It is further appreciated by one skilled in the art that the mode of translational inhibition illustrated by FIG. 1 with specific reference to translational inhibition exerted by VGAM133 gene, herein designated VGAM GENE, on one or more VGAM133 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM133 is inhibition of expression of host target genes, as part of a novel viral mechanism of attacking a host. Accordingly, utilities of VGAM133 include diagnosis, prevention and treatment of viral infection by Vaccinia virus. Specific functions, and accordingly utilities, of VGAM133 correlate with, and may be deduced from, the identity of the host target genes which VGAM133 binds and inhibits, and the function of these host target genes, as elaborated hereinbelow.

Nucleotide sequences of the VGAM133 precursor RNA, herein designated VGAM PRECURSOR RNA, and of the diced VGAM133 RNA, herein designated VGAM RNA, and a schematic representation of the secondary folding of VGAM133 folded precursor RNA, herein designated VGAM FOLDED PRECURSOR RNA, of VGAM133 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM133 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 134 (VGAM134) viral gene, which modulates expression of respective host target genes thereof, the function and utility of which host target genes is known in the art.

VGAM134 is a novel bioinformatically detected regulatory, non protein coding, viral micro RNA (miRNA) gene. The method by which VGAM134 was detected is described hereinabove with reference to FIGS. 2-8.

VGAM134 gene, herein designated VGAM GENE, is a viral gene contained in the genome of Vaccinia virus. VGAM134 host target gene, herein designated VGAM HOST TARGET GENE, is a human gene contained in the human genome.

VGAM134 gene, herein designated VGAM GENE, encodes a VGAM134 precursor RNA, herein designated VGAM PRECURSOR RNA. Similar to other miRNA genes, and unlike most ordinary genes, VGAM134 precursor RNA, herein designated VGAM PRECURSOR RNA, does not encode a protein. A nucleotide sequence identical or highly similar to the nucleotide sequence of VGAM134 precursor RNA is designated SEQ ID:120, and is provided hereinbelow with reference to the sequence listing part. Nucleotide sequence SEQ ID:120 is located at position 62005 relative to the genome of Vaccinia virus.

VGAM134 precursor RNA, herein designated VGAM PRECURSOR RNA, folds onto itself, forming VGAM134 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM134 folded precursor RNA, herein designated VGAM FOLDED PRECURSOR RNA, into VGAM134 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 88%) nucleotide sequence of VGAM134 RNA is designated SEQ ID:469, and is provided hereinbelow with reference to the sequence listing part.

VGAM134 host target gene, herein designated VGAM HOST TARGET GENE, encodes a corresponding messenger RNA, VGAM134 host target RNA, herein designated VGAM HOST TARGET RNA. VGAM134 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM134 RNA, herein designated VGAM RNA, binds complementarily to one or more host target binding sites located in untranslated regions of VGAM134 host target RNA, herein designated VGAM HOST TARGET RNA. This complementary binding is due to the fact that the nucleotide sequence of VGAM134 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM134 RNA, herein designated VGAM RNA, may have a different number of host target binding sites in untranslated regions of a VGAM134 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM134 RNA, herein designated VGAM RNA, to host target binding sites on VGAM134 host target RNA, herein designated VGAM HOST TARGET RNA, such as BINDING SITE I, BINDING SITE II and BINDING SITE III, inhibits translation of VGAM134 host target RNA, herein designated VGAM HOST TARGET RNA, into VGAM134 host target protein, herein designated VGAM HOST TARGET PROTEIN. VGAM host target protein is therefore outlined by a broken line.

It is appreciated that VGAM134 host target gene, herein designated VGAM HOST TARGET GENE, in fact represents a plurality of VGAM134 host target genes. The mRNA of each one of this plurality of VGAM134 host target genes comprises one or more host target binding sites, each having a nucleotide sequence which is at least partly complementary to VGAM134 RNA, herein designated VGAM RNA, and which when bound by VGAM134 RNA, herein designated VGAM RNA, causes inhibition of translation of respective one or more VGAM134 host target proteins.

It is further appreciated by one skilled in the art that the mode of translational inhibition illustrated by FIG. 1 with specific reference to translational inhibition exerted by VGAM134 gene, herein designated VGAM GENE, on one or more VGAM134 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM134 is inhibition of expression of host target genes, as part of a novel viral mechanism of attacking a host. Accordingly, utilities of VGAM134 include diagnosis, prevention and treatment of viral infection by Vaccinia virus. Specific functions, and accordingly utilities, of VGAM134 correlate with, and may be deduced from, the identity of the host target genes which VGAM134 binds and inhibits, and the function of these host target genes, as elaborated hereinbelow.

Nucleotide sequences of the VGAM134 precursor RNA, herein designated VGAM PRECURSOR RNA, and of the diced VGAM134 RNA, herein designated VGAM RNA, and a schematic representation of the secondary folding of VGAM134 folded precursor RNA, herein designated VGAM FOLDED PRECURSOR RNA, of VGAM134 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM134 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 135 (VGAM135) viral gene, which modulates expression of respective host target genes thereof, the function and utility of which host target genes is known in the art.

VGAM135 is a novel bioinformatically detected regulatory, non protein coding, viral micro RNA (miRNA) gene. The method by which VGAM135 was detected is described hereinabove with reference to FIGS. 2-8.

VGAM135 gene, herein designated VGAM GENE, is a viral gene contained in the genome of Vaccinia virus. VGAM135 host target gene, herein designated VGAM HOST TARGET GENE, is a human gene contained in the human genome.

VGAM135 gene, herein designated VGAM GENE, encodes a VGAM135 precursor RNA, herein designated VGAM PRECURSOR RNA. Similar to other miRNA genes, and unlike most ordinary genes, VGAM135 precursor RNA, herein designated VGAM PRECURSOR RNA, does not encode a protein. A nucleotide sequence identical or highly similar to the nucleotide sequence of VGAM135 precursor RNA is designated SEQ ID:121, and is provided hereinbelow with reference to the sequence listing part. Nucleotide sequence SEQ ID:121 is located at position 64481 relative to the genome of Vaccinia virus.

VGAM135 precursor RNA, herein designated VGAM PRECURSOR RNA, folds onto itself, forming VGAM135 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM135 folded precursor RNA, herein designated VGAM FOLDED PRECURSOR RNA, into VGAM135 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 77%) nucleotide sequence of VGAM135 RNA is designated SEQ ID:470, and is provided hereinbelow with reference to the sequence listing part.

VGAM135 host target gene, herein designated VGAM HOST TARGET GENE, encodes a corresponding messenger RNA, VGAM135 host target RNA, herein designated VGAM HOST TARGET RNA. VGAM135 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM135 RNA, herein designated VGAM RNA, binds complementarily to one or more host target binding sites located in untranslated regions of VGAM135 host target RNA, herein designated VGAM HOST TARGET RNA. This complementary binding is due to the fact that the nucleotide sequence of VGAM135 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM135 RNA, herein designated VGAM RNA, may have a different number of host target binding sites in untranslated regions of a VGAM135 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM135 RNA, herein designated VGAM RNA, to host target binding sites on VGAM135 host target RNA, herein designated VGAM HOST TARGET RNA, such as BINDING SITE I, BINDING SITE II and BINDING SITE III, inhibits translation of VGAM135 host target RNA, herein designated VGAM HOST TARGET RNA, into VGAM135 host target protein, herein designated VGAM HOST TARGET PROTEIN. VGAM host target protein is therefore outlined by a broken line.

It is appreciated that VGAM135 host target gene, herein designated VGAM HOST TARGET GENE, in fact represents a plurality of VGAM135 host target genes. The mRNA of each one of this plurality of VGAM135 host target genes comprises one or more host target binding sites, each having a nucleotide sequence which is at least partly complementary to VGAM135 RNA, herein designated VGAM RNA, and which when bound by VGAM135 RNA, herein designated VGAM RNA, causes inhibition of translation of respective one or more VGAM135 host target proteins.

It is further appreciated by one skilled in the art that the mode of translational inhibition illustrated by FIG. 1 with specific reference to translational inhibition exerted by VGAM135 gene, herein designated VGAM GENE, on one or more VGAM135 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM135 is inhibition of expression of host target genes, as part of a novel viral mechanism of attacking a host. Accordingly, utilities of VGAM135 include diagnosis, prevention and treatment of viral infection by Vaccinia virus. Specific functions, and accordingly utilities, of VGAM135 correlate with, and may be deduced from, the identity of the host target genes which VGAM135 binds and inhibits, and the function of these host target genes, as elaborated hereinbelow.

Nucleotide sequences of the VGAM135 precursor RNA, herein designated VGAM PRECURSOR RNA, and of the diced VGAM135 RNA, herein designated VGAM RNA, and a schematic representation of the secondary folding of VGAM135 folded precursor RNA, herein designated VGAM FOLDED PRECURSOR RNA, of VGAM135 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM135 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 136 (VGAM136) viral gene, which modulates expression of respective host target genes thereof, the function and utility of which host target genes is known in the art.

VGAM136 is a novel bioinformatically detected regulatory, non protein coding, viral micro RNA (miRNA) gene. The method by which VGAM136 was detected is described hereinabove with reference to FIGS. 2-8.

VGAM136 gene, herein designated VGAM GENE, is a viral gene contained in the genome of Vaccinia virus. VGAM136 host target gene, herein designated VGAM HOST TARGET GENE, is a human gene contained in the human genome.

VGAM136 gene, herein designated VGAM GENE, encodes a VGAM136 precursor RNA, herein designated VGAM PRECURSOR RNA. Similar to other miRNA genes, and unlike most ordinary genes, VGAM136 precursor RNA, herein designated VGAM PRECURSOR RNA, does not encode a protein. A nucleotide sequence identical or highly similar to the nucleotide sequence of VGAM136 precursor RNA is designated SEQ ID:122, and is provided hereinbelow with reference to the sequence listing part. Nucleotide sequence SEQ ID:122 is located at position 65175 relative to the genome of Vaccinia virus.

VGAM136 precursor RNA, herein designated VGAM PRECURSOR RNA, folds onto itself, forming VGAM136 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM136 folded precursor RNA, herein designated VGAM FOLDED PRECURSOR RNA, into VGAM136 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM136 RNA is designated SEQ ID:471, and is provided hereinbelow with reference to the sequence listing part.

VGAM136 host target gene, herein designated VGAM HOST TARGET GENE, encodes a corresponding messenger RNA, VGAM136 host target RNA, herein designated VGAM HOST TARGET RNA. VGAM136 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM136 RNA, herein designated VGAM RNA, binds complementarily to one or more host target binding sites located in untranslated regions of VGAM136 host target RNA, herein designated VGAM HOST TARGET RNA. This complementary binding is due to the fact that the nucleotide sequence of VGAM136 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM136 RNA, herein designated VGAM RNA, may have a different number of host target binding sites in untranslated regions of a VGAM136 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM136 RNA, herein designated VGAM RNA, to host target binding sites on VGAM136 host target RNA, herein designated VGAM HOST TARGET RNA, such as BINDING SITE I, BINDING SITE II and BINDING SITE III, inhibits translation of VGAM136 host target RNA, herein designated VGAM HOST TARGET RNA, into VGAM136 host target protein, herein designated VGAM HOST TARGET PROTEIN. VGAM host target protein is therefore outlined by a broken line.

It is appreciated that VGAM136 host target gene, herein designated VGAM HOST TARGET GENE, in fact represents a plurality of VGAM136 host target genes. The mRNA of each one of this plurality of VGAM136 host target genes comprises one or more host target binding sites, each having a nucleotide sequence which is at least partly complementary to VGAM136 RNA, herein designated VGAM RNA, and which when bound by VGAM136 RNA, herein designated VGAM RNA, causes inhibition of translation of respective one or more VGAM136 host target proteins.

It is further appreciated by one skilled in the art that the mode of translational inhibition illustrated by FIG. 1 with specific reference to translational inhibition exerted by VGAM136 gene, herein designated VGAM GENE, on one or more VGAM136 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM136 is inhibition of expression of host target genes, as part of a novel viral mechanism of attacking a host. Accordingly, utilities of VGAM136 include diagnosis, prevention and treatment of viral infection by Vaccinia virus. Specific functions, and accordingly utilities, of VGAM136 correlate with, and may be deduced from, the identity of the host target genes which VGAM136 binds and inhibits, and the function of these host target genes, as elaborated hereinbelow.

Nucleotide sequences of the VGAM136 precursor RNA, herein designated VGAM PRECURSOR RNA, and of the diced VGAM136 RNA, herein designated VGAM RNA, and a schematic representation of the secondary folding of VGAM136 folded precursor RNA, herein designated VGAM FOLDED PRECURSOR RNA, of VGAM136 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM136 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 137 (VGAM137) viral gene, which modulates expression of respective host target genes thereof, the function and utility of which host target genes is known in the art.

VGAM137 is a novel bioinformatically detected regulatory, non protein coding, viral micro RNA (miRNA) gene. The method by which VGAM137 was detected is described hereinabove with reference to FIGS. 2-8.

VGAM137 gene, herein designated VGAM GENE, is a viral gene contained in the genome of Vaccinia virus. VGAM137 host target gene, herein designated VGAM HOST TARGET GENE, is a human gene contained in the human genome.

VGAM137 gene, herein designated VGAM GENE, encodes a VGAM137 precursor RNA, herein designated VGAM PRECURSOR RNA. Similar to other miRNA genes, and unlike most ordinary genes, VGAM137 precursor RNA, herein designated VGAM PRECURSOR RNA, does not encode a protein. A nucleotide sequence identical or highly similar to the nucleotide sequence of VGAM137 precursor RNA is designated SEQ ID:123, and is provided hereinbelow with reference to the sequence listing part. Nucleotide sequence SEQ ID:123 is located at position 64691 relative to the genome of Vaccinia virus.

VGAM137 precursor RNA, herein designated VGAM PRECURSOR RNA, folds onto itself, forming VGAM137 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM137 folded precursor RNA, herein designated VGAM FOLDED PRECURSOR RNA, into VGAM137 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 90%) nucleotide sequence of VGAM137 RNA is designated SEQ ID:472, and is provided hereinbelow with reference to the sequence listing part.

VGAM137 host target gene, herein designated VGAM HOST TARGET GENE, encodes a corresponding messenger RNA, VGAM137 host target RNA, herein designated VGAM HOST TARGET RNA. VGAM137 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM137 RNA, herein designated VGAM RNA, binds complementarily to one or more host target binding sites located in untranslated regions of VGAM137 host target RNA, herein designated VGAM HOST TARGET RNA. This complementary binding is due to the fact that the nucleotide sequence of VGAM137 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM137 RNA, herein designated VGAM RNA, may have a different number of host target binding sites in untranslated regions of a VGAM137 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM137 RNA, herein designated VGAM RNA, to host target binding sites on VGAM137 host target RNA, herein designated VGAM HOST TARGET RNA, such as BINDING SITE I, BINDING SITE II and BINDING SITE III, inhibits translation of VGAM137 host target RNA, herein designated VGAM HOST TARGET RNA, into VGAM137 host target protein, herein designated VGAM HOST TARGET PROTEIN. VGAM host target protein is therefore outlined by a broken line.

It is appreciated that VGAM137 host target gene, herein designated VGAM HOST TARGET GENE, in fact represents a plurality of VGAM137 host target genes. The mRNA of each one of this plurality of VGAM137 host target genes comprises one or more host target binding sites, each having a nucleotide sequence which is at least partly complementary to VGAM137 RNA, herein designated VGAM RNA, and which when bound by VGAM137 RNA, herein designated VGAM RNA, causes inhibition of translation of respective one or more VGAM137 host target proteins.

It is further appreciated by one skilled in the art that the mode of translational inhibition illustrated by FIG. 1 with specific reference to translational inhibition exerted by VGAM137 gene, herein designated VGAM GENE, on one or more VGAM137 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM137 is inhibition of expression of host target genes, as part of a novel viral mechanism of attacking a host. Accordingly, utilities of VGAM137 include diagnosis, prevention and treatment of viral infection by Vaccinia virus. Specific functions, and accordingly utilities, of VGAM137 correlate with, and may be deduced from, the identity of the host target genes which VGAM137 binds and inhibits, and the function of these host target genes, as elaborated hereinbelow.

Nucleotide sequences of the VGAM137 precursor RNA, herein designated VGAM PRECURSOR RNA, and of the diced VGAM137 RNA, herein designated VGAM RNA, and a schematic representation of the secondary folding of VGAM137 folded precursor RNA, herein designated VGAM FOLDED PRECURSOR RNA, of VGAM137 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM137 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 138 (VGAM138) viral gene, which modulates expression of respective host target genes thereof, the function and utility of which host target genes is known in the art.

VGAM138 is a novel bioinformatically detected regulatory, non protein coding, viral micro RNA (miRNA) gene. The method by which VGAM138 was detected is described hereinabove with reference to FIGS. 2-8.

VGAM138 gene, herein designated VGAM GENE, is a viral gene contained in the genome of Vaccinia virus. VGAM138 host target gene, herein designated VGAM HOST TARGET GENE, is a human gene contained in the human genome.

VGAM138 gene, herein designated VGAM GENE, encodes a VGAM138 precursor RNA, herein designated VGAM PRECURSOR RNA. Similar to other miRNA genes, and unlike most ordinary genes, VGAM138 precursor RNA, herein designated VGAM PRECURSOR RNA, does not encode a protein. A nucleotide sequence identical or highly similar to the nucleotide sequence of VGAM138 precursor RNA is designated SEQ ID:124, and is provided hereinbelow with reference to the sequence listing part. Nucleotide sequence SEQ ID:124 is located at position 63387 relative to the genome of Vaccinia virus.

VGAM138 precursor RNA, herein designated VGAM PRECURSOR RNA, folds onto itself, forming VGAM138 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM138 folded precursor RNA, herein designated VGAM FOLDED PRECURSOR RNA, into VGAM138 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 85%) nucleotide sequence of VGAM138 RNA is designated SEQ ID:473, and is provided hereinbelow with reference to the sequence listing part.

VGAM138 host target gene, herein designated VGAM HOST TARGET GENE, encodes a corresponding messenger RNA, VGAM138 host target RNA, herein designated VGAM HOST TARGET RNA. VGAM138 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM138 RNA, herein designated VGAM RNA, binds complementarily to one or more host target binding sites located in untranslated regions of VGAM138 host target RNA, herein designated VGAM HOST TARGET RNA. This complementary binding is due to the fact that the nucleotide sequence of VGAM138 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM138 RNA, herein designated VGAM RNA, may have a different number of host target binding sites in untranslated regions of a VGAM138 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM138 RNA, herein designated VGAM RNA, to host target binding sites on VGAM138 host target RNA, herein designated VGAM HOST TARGET RNA, such as BINDING SITE I, BINDING SITE II and BINDING SITE III, inhibits translation of VGAM138 host target RNA, herein designated VGAM HOST TARGET RNA, into VGAM138 host target protein, herein designated VGAM HOST TARGET PROTEIN. VGAM host target protein is therefore outlined by a broken line.

It is appreciated that VGAM138 host target gene, herein designated VGAM HOST TARGET GENE, in fact represents a plurality of VGAM138 host target genes. The mRNA of each one of this plurality of VGAM138 host target genes comprises one or more host target binding sites, each having a nucleotide sequence which is at least partly complementary to VGAM138 RNA, herein designated VGAM RNA, and which when bound by VGAM138 RNA, herein designated VGAM RNA, causes inhibition of translation of respective one or more VGAM138 host target proteins.

It is further appreciated by one skilled in the art that the mode of translational inhibition illustrated by FIG. 1 with specific reference to translational inhibition exerted by VGAM138 gene, herein designated VGAM GENE, on one or more VGAM138 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM138 is inhibition of expression of host target genes, as part of a novel viral mechanism of attacking a host. Accordingly, utilities of VGAM138 include diagnosis, prevention and treatment of viral infection by Vaccinia virus. Specific functions, and accordingly utilities, of VGAM138 correlate with, and may be deduced from, the identity of the host target genes which VGAM138 binds and inhibits, and the function of these host target genes, as elaborated hereinbelow.

Nucleotide sequences of the VGAM138 precursor RNA, herein designated VGAM PRECURSOR RNA, and of the diced VGAM138 RNA, herein designated VGAM RNA, and a schematic representation of the secondary folding of VGAM138 folded precursor RNA, herein designated VGAM FOLDED PRECURSOR RNA, of VGAM138 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM138 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 139 (VGAM139) viral gene, which modulates expression of respective host target genes thereof, the function and utility of which host target genes is known in the art.

VGAM139 is a novel bioinformatically detected regulatory, non protein coding, viral micro RNA (miRNA) gene. The method by which VGAM139 was detected is described hereinabove with reference to FIGS. 2-8.

VGAM139 gene, herein designated VGAM GENE, is a viral gene contained in the genome of Vaccinia virus. VGAM139 host target gene, herein designated VGAM HOST TARGET GENE, is a human gene contained in the human genome.

VGAM139 gene, herein designated VGAM GENE, encodes a VGAM139 precursor RNA, herein designated VGAM PRECURSOR RNA. Similar to other miRNA genes, and unlike most ordinary genes, VGAM139 precursor RNA, herein designated VGAM PRECURSOR RNA, does not encode a protein. A nucleotide sequence identical or highly similar to the nucleotide sequence of VGAM139 precursor RNA is designated SEQ ID:125, and is provided hereinbelow with reference to the sequence listing part. Nucleotide sequence SEQ ID:125 is located at position 63571 relative to the genome of Vaccinia virus.

VGAM139 precursor RNA, herein designated VGAM PRECURSOR RNA, folds onto itself, forming VGAM139 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM139 folded precursor RNA, herein designated VGAM FOLDED PRECURSOR RNA, into VGAM139 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 89%) nucleotide sequence of VGAM139 RNA is designated SEQ ID:474, and is provided hereinbelow with reference to the sequence listing part.

VGAM139 host target gene, herein designated VGAM HOST TARGET GENE, encodes a corresponding messenger RNA, VGAM139 host target RNA, herein designated VGAM HOST TARGET RNA. VGAM139 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM139 RNA, herein designated VGAM RNA, binds complementarily to one or more host target binding sites located in untranslated regions of VGAM139 host target RNA, herein designated VGAM HOST TARGET RNA. This complementary binding is due to the fact that the nucleotide sequence of VGAM139 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM139 RNA, herein designated VGAM RNA, may have a different number of host target binding sites in untranslated regions of a VGAM139 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM139 RNA, herein designated VGAM RNA, to host target binding sites on VGAM139 host target RNA, herein designated VGAM HOST TARGET RNA, such as BINDING SITE I, BINDING SITE II and BINDING SITE III, inhibits translation of VGAM139 host target RNA, herein designated VGAM HOST TARGET RNA, into VGAM139 host target protein, herein designated VGAM HOST TARGET PROTEIN. VGAM host target protein is therefore outlined by a broken line.

It is appreciated that VGAM139 host target gene, herein designated VGAM HOST TARGET GENE, in fact represents a plurality of VGAM139 host target genes. The mRNA of each one of this plurality of VGAM139 host target genes comprises one or more host target binding sites, each having a nucleotide sequence which is at least partly complementary to VGAM139 RNA, herein designated VGAM RNA, and which when bound by VGAM139 RNA, herein designated VGAM RNA, causes inhibition of translation of respective one or more VGAM139 host target proteins.

It is further appreciated by one skilled in the art that the mode of translational inhibition illustrated by FIG. 1 with specific reference to translational inhibition exerted by VGAM139 gene, herein designated VGAM GENE, on one or more VGAM139 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM139 is inhibition of expression of host target genes, as part of a novel viral mechanism of attacking a host. Accordingly, utilities of VGAM139 include diagnosis, prevention and treatment of viral infection by Vaccinia virus. Specific functions, and accordingly utilities, of VGAM139 correlate with, and may be deduced from, the identity of the host target genes which VGAM139 binds and inhibits, and the function of these host target genes, as elaborated hereinbelow.

Nucleotide sequences of the VGAM139 precursor RNA, herein designated VGAM PRECURSOR RNA, and of the diced VGAM139 RNA, herein designated VGAM RNA, and a schematic representation of the secondary folding of VGAM139 folded precursor RNA, herein designated VGAM FOLDED PRECURSOR RNA, of VGAM139 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM139 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 140 (VGAM140) viral gene, which modulates expression of respective host target genes thereof, the function and utility of which host target genes is known in the art.

VGAM140 is a novel bioinformatically detected regulatory, non protein coding, viral micro RNA (miRNA) gene. The method by which VGAM140 was detected is described hereinabove with reference to FIGS. 2-8.

VGAM140 gene, herein designated VGAM GENE, is a viral gene contained in the genome of Vaccinia virus. VGAM140 host target gene, herein designated VGAM HOST TARGET GENE, is a human gene contained in the human genome.

VGAM140 gene, herein designated VGAM GENE, encodes a VGAM140 precursor RNA, herein designated VGAM PRECURSOR RNA. Similar to other miRNA genes, and unlike most ordinary genes, VGAM140 precursor RNA, herein designated VGAM PRECURSOR RNA, does not encode a protein. A nucleotide sequence identical or highly similar to the nucleotide sequence of VGAM140 precursor RNA is designated SEQ ID:126, and is provided hereinbelow with reference to the sequence listing part. Nucleotide sequence SEQ ID:126 is located at position 62804 relative to the genome of Vaccinia virus.

VGAM140 precursor RNA, herein designated VGAM PRECURSOR RNA, folds onto itself, forming VGAM140 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM140 folded precursor RNA, herein designated VGAM FOLDED PRECURSOR RNA, into VGAM140 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM140 RNA is designated SEQ ID:475, and is provided hereinbelow with reference to the sequence listing part.

VGAM140 host target gene, herein designated VGAM HOST TARGET GENE, encodes a corresponding messenger RNA, VGAM140 host target RNA, herein designated VGAM HOST TARGET RNA. VGAM140 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM140 RNA, herein designated VGAM RNA, binds complementarily to one or more host target binding sites located in untranslated regions of VGAM140 host target RNA, herein designated VGAM HOST TARGET RNA. This complementary binding is due to the fact that the nucleotide sequence of VGAM140 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM140 RNA, herein designated VGAM RNA, may have a different number of host target binding sites in untranslated regions of a VGAM140 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM140 RNA, herein designated VGAM RNA, to host target binding sites on VGAM140 host target RNA, herein designated VGAM HOST TARGET RNA, such as BINDING SITE I, BINDING SITE II and BINDING SITE III, inhibits translation of VGAM140 host target RNA, herein designated VGAM HOST TARGET RNA, into VGAM140 host target protein, herein designated VGAM HOST TARGET PROTEIN. VGAM host target protein is therefore outlined by a broken line.

It is appreciated that VGAM140 host target gene, herein designated VGAM HOST TARGET GENE, in fact represents a plurality of VGAM140 host target genes. The mRNA of each one of this plurality of VGAM140 host target genes comprises one or more host target binding sites, each having a nucleotide sequence which is at least partly complementary to VGAM140 RNA, herein designated VGAM RNA, and which when bound by VGAM140 RNA, herein designated VGAM RNA, causes inhibition of translation of respective one or more VGAM140 host target proteins.

It is further appreciated by one skilled in the art that the mode of translational inhibition illustrated by FIG. 1 with specific reference to translational inhibition exerted by VGAM140 gene, herein designated VGAM GENE, on one or more VGAM140 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM140 is inhibition of expression of host target genes, as part of a novel viral mechanism of attacking a host. Accordingly, utilities of VGAM140 include diagnosis, prevention and treatment of viral infection by Vaccinia virus. Specific functions, and accordingly utilities, of VGAM140 correlate with, and may be deduced from, the identity of the host target genes which VGAM140 binds and inhibits, and the function of these host target genes, as elaborated hereinbelow.

Nucleotide sequences of the VGAM140 precursor RNA, herein designated VGAM PRECURSOR RNA, and of the diced VGAM140 RNA, herein designated VGAM RNA, and a schematic representation of the secondary folding of VGAM140 folded precursor RNA, herein designated VGAM FOLDED PRECURSOR RNA, of VGAM140 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM140 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 141 (VGAM141) viral gene, which modulates expression of respective host target genes thereof, the function and utility of which host target genes is known in the art.

VGAM141 is a novel bioinformatically detected regulatory, non protein coding, viral micro RNA (miRNA) gene. The method by which VGAM141 was detected is described hereinabove with reference to FIGS. 2-8.

VGAM141 gene, herein designated VGAM GENE, is a viral gene contained in the genome of Vaccinia virus. VGAM141 host target gene, herein designated VGAM HOST TARGET GENE, is a human gene contained in the human genome.

VGAM141 gene, herein designated VGAM GENE, encodes a VGAM141 precursor RNA, herein designated VGAM PRECURSOR RNA. Similar to other miRNA genes, and unlike most ordinary genes, VGAM141 precursor RNA, herein designated VGAM PRECURSOR RNA, does not encode a protein. A nucleotide sequence identical or highly similar to the nucleotide sequence of VGAM141 precursor RNA is designated SEQ ID:127, and is provided hereinbelow with reference to the sequence listing part. Nucleotide sequence SEQ ID:127 is located at position 62395 relative to the genome of Vaccinia virus.

VGAM141 precursor RNA, herein designated VGAM PRECURSOR RNA, folds onto itself, forming VGAM141 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM141 folded precursor RNA, herein designated VGAM FOLDED PRECURSOR RNA, into VGAM141 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 70%) nucleotide sequence of VGAM141 RNA is designated SEQ ID:476, and is provided hereinbelow with reference to the sequence listing part.

VGAM141 host target gene, herein designated VGAM HOST TARGET GENE, encodes a corresponding messenger RNA, VGAM141 host target RNA, herein designated VGAM HOST TARGET RNA. VGAM141 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM141 RNA, herein designated VGAM RNA, binds complementarily to one or more host target binding sites located in untranslated regions of VGAM141 host target RNA, herein designated VGAM HOST TARGET RNA. This complementary binding is due to the fact that the nucleotide sequence of VGAM141 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM141 RNA, herein designated VGAM RNA, may have a different number of host target binding sites in untranslated regions of a VGAM141 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM141 RNA, herein designated VGAM RNA, to host target binding sites on VGAM141 host target RNA, herein designated VGAM HOST TARGET RNA, such as BINDING SITE I, BINDING SITE II and BINDING SITE III, inhibits translation of VGAM141 host target RNA, herein designated VGAM HOST TARGET RNA, into VGAM141 host target protein, herein designated VGAM HOST TARGET PROTEIN. VGAM host target protein is therefore outlined by a broken line.

It is appreciated that VGAM141 host target gene, herein designated VGAM HOST TARGET GENE, in fact represents a plurality of VGAM141 host target genes. The mRNA of each one of this plurality of VGAM141 host target genes comprises one or more host target binding sites, each having a nucleotide sequence which is at least partly complementary to VGAM141 RNA, herein designated VGAM RNA, and which when bound by VGAM141 RNA, herein designated VGAM RNA, causes inhibition of translation of respective one or more VGAM141 host target proteins.

It is further appreciated by one skilled in the art that the mode of translational inhibition illustrated by FIG. 1 with specific reference to translational inhibition exerted by VGAM141 gene, herein designated VGAM GENE, on one or more VGAM141 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM141 is inhibition of expression of host target genes, as part of a novel viral mechanism of attacking a host. Accordingly, utilities of VGAM141 include diagnosis, prevention and treatment of viral infection by Vaccinia virus. Specific functions, and accordingly utilities, of VGAM141 correlate with, and may be deduced from, the identity of the host target genes which VGAM141 binds and inhibits, and the function of these host target genes, as elaborated hereinbelow.

Nucleotide sequences of the VGAM141 precursor RNA, herein designated VGAM PRECURSOR RNA, and of the diced VGAM141 RNA, herein designated VGAM RNA, and a schematic representation of the secondary folding of VGAM141 folded precursor RNA, herein designated VGAM FOLDED PRECURSOR RNA, of VGAM141 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM141 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 142 (VGAM142) viral gene, which modulates expression of respective host target genes thereof, the function and utility of which host target genes is known in the art.

VGAM142 is a novel bioinformatically detected regulatory, non protein coding, viral micro RNA (miRNA) gene. The method by which VGAM142 was detected is described hereinabove with reference to FIGS. 2-8.

VGAM142 gene, herein designated VGAM GENE, is a viral gene contained in the genome of Vaccinia virus. VGAM142 host target gene, herein designated VGAM HOST TARGET GENE, is a human gene contained in the human genome.

VGAM142 gene, herein designated VGAM GENE, encodes a VGAM142 precursor RNA, herein designated VGAM PRECURSOR RNA. Similar to other miRNA genes, and unlike most ordinary genes, VGAM142 precursor RNA, herein designated VGAM PRECURSOR RNA, does not encode a protein. A nucleotide sequence identical or highly similar to the nucleotide sequence of VGAM142 precursor RNA is designated SEQ ID:128, and is provided hereinbelow with reference to the sequence listing part. Nucleotide sequence SEQ ID:128 is located at position 67919 relative to the genome of Vaccinia virus.

VGAM142 precursor RNA, herein designated VGAM PRECURSOR RNA, folds onto itself, forming VGAM142 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM142 folded precursor RNA, herein designated VGAM FOLDED PRECURSOR RNA, into VGAM142 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM142 RNA is designated SEQ ID:477, and is provided hereinbelow with reference to the sequence listing part.

VGAM142 host target gene, herein designated VGAM HOST TARGET GENE, encodes a corresponding messenger RNA, VGAM142 host target RNA, herein designated VGAM HOST TARGET RNA. VGAM142 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM142 RNA, herein designated VGAM RNA, binds complementarily to one or more host target binding sites located in untranslated regions of VGAM142 host target RNA, herein designated VGAM HOST TARGET RNA. This complementary binding is due to the fact that the nucleotide sequence of VGAM142 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM142 RNA, herein designated VGAM RNA, may have a different number of host target binding sites in untranslated regions of a VGAM142 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM142 RNA, herein designated VGAM RNA, to host target binding sites on VGAM142 host target RNA, herein designated VGAM HOST TARGET RNA, such as BINDING SITE I, BINDING SITE II and BINDING SITE III, inhibits translation of VGAM142 host target RNA, herein designated VGAM HOST TARGET RNA, into VGAM142 host target protein, herein designated VGAM HOST TARGET PROTEIN. VGAM host target protein is therefore outlined by a broken line.

It is appreciated that VGAM142 host target gene, herein designated VGAM HOST TARGET GENE, in fact represents a plurality of VGAM142 host target genes. The mRNA of each one of this plurality of VGAM142 host target genes comprises one or more host target binding sites, each having a nucleotide sequence which is at least partly complementary to VGAM142 RNA, herein designated VGAM RNA, and which when bound by VGAM142 RNA, herein designated VGAM RNA, causes inhibition of translation of respective one or more VGAM142 host target proteins.

It is further appreciated by one skilled in the art that the mode of translational inhibition illustrated by FIG. 1 with specific reference to translational inhibition exerted by VGAM142 gene, herein designated VGAM GENE, on one or more VGAM142 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM142 is inhibition of expression of host target genes, as part of a novel viral mechanism of attacking a host. Accordingly, utilities of VGAM142 include diagnosis, prevention and treatment of viral infection by Vaccinia virus. Specific functions, and accordingly utilities, of VGAM142 correlate with, and may be deduced from, the identity of the host target genes which VGAM142 binds and inhibits, and the function of these host target genes, as elaborated hereinbelow.

Nucleotide sequences of the VGAM142 precursor RNA, herein designated VGAM PRECURSOR RNA, and of the diced VGAM142 RNA, herein designated VGAM RNA, and a schematic representation of the secondary folding of VGAM142 folded precursor RNA, herein designated VGAM FOLDED PRECURSOR RNA, of VGAM142 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM142 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 143 (VGAM143) viral gene, which modulates expression of respective host target genes thereof, the function and utility of which host target genes is known in the art.

VGAM143 is a novel bioinformatically detected regulatory, non protein coding, viral micro RNA (miRNA) gene. The method by which VGAM143 was detected is described hereinabove with reference to FIGS. 2-8.

VGAM143 gene, herein designated VGAM GENE, is a viral gene contained in the genome of Vaccinia virus. VGAM143 host target gene, herein designated VGAM HOST TARGET GENE, is a human gene contained in the human genome.

VGAM143 gene, herein designated VGAM GENE, encodes a VGAM143 precursor RNA, herein designated VGAM PRECURSOR RNA. Similar to other miRNA genes, and unlike most ordinary genes, VGAM143 precursor RNA, herein designated VGAM PRECURSOR RNA, does not encode a protein. A nucleotide sequence identical or highly similar to the nucleotide sequence of VGAM143 precursor RNA is designated SEQ ID:129, and is provided hereinbelow with reference to the sequence listing part. Nucleotide sequence SEQ ID:129 is located at position 69887 relative to the genome of Vaccinia virus.

VGAM143 precursor RNA, herein designated VGAM PRECURSOR RNA, folds onto itself, forming VGAM143 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM143 folded precursor RNA, herein designated VGAM FOLDED PRECURSOR RNA, into VGAM143 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 25%) nucleotide sequence of VGAM143 RNA is designated SEQ ID:478, and is provided hereinbelow with reference to the sequence listing part.

VGAM143 host target gene, herein designated VGAM HOST TARGET GENE, encodes a corresponding messenger RNA, VGAM143 host target RNA, herein designated VGAM HOST TARGET RNA. VGAM143 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM143 RNA, herein designated VGAM RNA, binds complementarily to one or more host target binding sites located in untranslated regions of VGAM143 host target RNA, herein designated VGAM HOST TARGET RNA. This complementary binding is due to the fact that the nucleotide sequence of VGAM143 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM143 RNA, herein designated VGAM RNA, may have a different number of host target binding sites in untranslated regions of a VGAM143 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM143 RNA, herein designated VGAM RNA, to host target binding sites on VGAM143 host target RNA, herein designated VGAM HOST TARGET RNA, such as BINDING SITE I, BINDING SITE II and BINDING SITE III, inhibits translation of VGAM143 host target RNA, herein designated VGAM HOST TARGET RNA, into VGAM143 host target protein, herein designated VGAM HOST TARGET PROTEIN. VGAM host target protein is therefore outlined by a broken line.

It is appreciated that VGAM143 host target gene, herein designated VGAM HOST TARGET GENE, in fact represents a plurality of VGAM143 host target genes. The mRNA of each one of this plurality of VGAM143 host target genes comprises one or more host target binding sites, each having a nucleotide sequence which is at least partly complementary to VGAM143 RNA, herein designated VGAM RNA, and which when bound by VGAM143 RNA, herein designated VGAM RNA, causes inhibition of translation of respective one or more VGAM143 host target proteins.

It is further appreciated by one skilled in the art that the mode of translational inhibition illustrated by FIG. 1 with specific reference to translational inhibition exerted by VGAM143 gene, herein designated VGAM GENE, on one or more VGAM143 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM143 is inhibition of expression of host target genes, as part of a novel viral mechanism of attacking a host. Accordingly, utilities of VGAM143 include diagnosis, prevention and treatment of viral infection by Vaccinia virus. Specific functions, and accordingly utilities, of VGAM143 correlate with, and may be deduced from, the identity of the host target genes which VGAM143 binds and inhibits, and the function of these host target genes, as elaborated hereinbelow.

Nucleotide sequences of the VGAM143 precursor RNA, herein designated VGAM PRECURSOR RNA, and of the diced VGAM143 RNA, herein designated VGAM RNA, and a schematic representation of the secondary folding of VGAM143 folded precursor RNA, herein designated VGAM FOLDED PRECURSOR RNA, of VGAM143 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM143 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 144 (VGAM144) viral gene, which modulates expression of respective host target genes thereof, the function and utility of which host target genes is known in the art.

VGAM144 is a novel bioinformatically detected regulatory, non protein coding, viral micro RNA (miRNA) gene. The method by which VGAM144 was detected is described hereinabove with reference to FIGS. 2-8.

VGAM144 gene, herein designated VGAM GENE, is a viral gene contained in the genome of Vaccinia virus. VGAM144 host target gene, herein designated VGAM HOST TARGET GENE, is a human gene contained in the human genome.

VGAM144 gene, herein designated VGAM GENE, encodes a VGAM144 precursor RNA, herein designated VGAM PRECURSOR RNA. Similar to other miRNA genes, and unlike most ordinary genes, VGAM144 precursor RNA, herein designated VGAM PRECURSOR RNA, does not encode a protein. A nucleotide sequence identical or highly similar to the nucleotide sequence of VGAM144 precursor RNA is designated SEQ ID:130, and is provided hereinbelow with reference to the sequence listing part. Nucleotide sequence SEQ ID:130 is located at position 68429 relative to the genome of Vaccinia virus.

VGAM144 precursor RNA, herein designated VGAM PRECURSOR RNA, folds onto itself, forming VGAM144 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM144 folded precursor RNA, herein designated VGAM FOLDED PRECURSOR RNA, into VGAM144 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 85%) nucleotide sequence of VGAM144 RNA is designated SEQ ID:479, and is provided hereinbelow with reference to the sequence listing part.

VGAM144 host target gene, herein designated VGAM HOST TARGET GENE, encodes a corresponding messenger RNA, VGAM144 host target RNA, herein designated VGAM HOST TARGET RNA. VGAM144 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM144 RNA, herein designated VGAM RNA, binds complementarily to one or more host target binding sites located in untranslated regions of VGAM144 host target RNA, herein designated VGAM HOST TARGET RNA. This complementary binding is due to the fact that the nucleotide sequence of VGAM144 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM144 RNA, herein designated VGAM RNA, may have a different number of host target binding sites in untranslated regions of a VGAM144 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM144 RNA, herein designated VGAM RNA, to host target binding sites on VGAM144 host target RNA, herein designated VGAM HOST TARGET RNA, such as BINDING SITE I, BINDING SITE II and BINDING SITE III, inhibits translation of VGAM144 host target RNA, herein designated VGAM HOST TARGET RNA, into VGAM144 host target protein, herein designated VGAM HOST TARGET PROTEIN. VGAM host target protein is therefore outlined by a broken line.

It is appreciated that VGAM144 host target gene, herein designated VGAM HOST TARGET GENE, in fact represents a plurality of VGAM144 host target genes. The mRNA of each one of this plurality of VGAM144 host target genes comprises one or more host target binding sites, each having a nucleotide sequence which is at least partly complementary to VGAM144 RNA, herein designated VGAM RNA, and which when bound by VGAM144 RNA, herein designated VGAM RNA, causes inhibition of translation of respective one or more VGAM144 host target proteins.

It is further appreciated by one skilled in the art that the mode of translational inhibition illustrated by FIG. 1 with specific reference to translational inhibition exerted by VGAM144 gene, herein designated VGAM GENE, on one or more VGAM144 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM144 is inhibition of expression of host target genes, as part of a novel viral mechanism of attacking a host. Accordingly, utilities of VGAM144 include diagnosis, prevention and treatment of viral infection by Vaccinia virus. Specific functions, and accordingly utilities, of VGAM144 correlate with, and may be deduced from, the identity of the host target genes which VGAM144 binds and inhibits, and the function of these host target genes, as elaborated hereinbelow.

Nucleotide sequences of the VGAM144 precursor RNA, herein designated VGAM PRECURSOR RNA, and of the diced VGAM144 RNA, herein designated VGAM RNA, and a schematic representation of the secondary folding of VGAM144 folded precursor RNA, herein designated VGAM FOLDED PRECURSOR RNA, of VGAM144 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM144 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 145 (VGAM145) viral gene, which modulates expression of respective host target genes thereof, the function and utility of which host target genes is known in the art.

VGAM145 is a novel bioinformatically detected regulatory, non protein coding, viral micro RNA (miRNA) gene. The method by which VGAM145 was detected is described hereinabove with reference to FIGS. 2-8.

VGAM145 gene, herein designated VGAM GENE, is a viral gene contained in the genome of Vaccinia virus.

VGAM145 host target gene, herein designated VGAM HOST TARGET GENE, is a human gene contained in the human genome.

VGAM145 gene, herein designated VGAM GENE, encodes a VGAM145 precursor RNA, herein designated VGAM PRECURSOR RNA. Similar to other miRNA genes, and unlike most ordinary genes, VGAM145 precursor RNA, herein designated VGAM PRECURSOR RNA, does not encode a protein. A nucleotide sequence identical or highly similar to the nucleotide sequence of VGAM145 precursor RNA is designated SEQ ID:131, and is provided hereinbelow with reference to the sequence listing part. Nucleotide sequence SEQ ID:131 is located at position 67126 relative to the genome of Vaccinia virus.

VGAM145 precursor RNA, herein designated VGAM PRECURSOR RNA, folds onto itself, forming VGAM145 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM145 folded precursor RNA, herein designated VGAM FOLDED PRECURSOR RNA, into VGAM145 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 76%) nucleotide sequence of VGAM145 RNA is designated SEQ ID:480, and is provided hereinbelow with reference to the sequence listing part.

VGAM145 host target gene, herein designated VGAM HOST TARGET GENE, encodes a corresponding messenger RNA, VGAM145 host target RNA, herein designated VGAM HOST TARGET RNA. VGAM145 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM145 RNA, herein designated VGAM RNA, binds complementarily to one or more host target binding sites located in untranslated regions of VGAM145 host target RNA, herein designated VGAM HOST TARGET RNA. This complementary binding is due to the fact that the nucleotide sequence of VGAM145 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM145 RNA, herein designated VGAM RNA, may have a different number of host target binding sites in untranslated regions of a VGAM145 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM145 RNA, herein designated VGAM RNA, to host target binding sites on VGAM145 host target RNA, herein designated VGAM HOST TARGET RNA, such as BINDING SITE I, BINDING SITE II and BINDING SITE III, inhibits translation of VGAM145 host target RNA, herein designated VGAM HOST TARGET RNA, into VGAM145 host target protein, herein designated VGAM HOST TARGET PROTEIN. VGAM host target protein is therefore outlined by a broken line.

It is appreciated that VGAM145 host target gene, herein designated VGAM HOST TARGET GENE, in fact represents a plurality of VGAM145 host target genes. The mRNA of each one of this plurality of VGAM145 host target genes comprises one or more host target binding sites, each having a nucleotide sequence which is at least partly complementary to VGAM145 RNA, herein designated VGAM RNA, and which when bound by VGAM145 RNA, herein designated VGAM RNA, causes inhibition of translation of respective one or more VGAM145 host target proteins.

It is further appreciated by one skilled in the art that the mode of translational inhibition illustrated by FIG. 1 with specific reference to translational inhibition exerted by VGAM145 gene, herein designated VGAM GENE, on one or more VGAM145 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM145 is inhibition of expression of host target genes, as part of a novel viral mechanism of attacking a host. Accordingly, utilities of VGAM145 include diagnosis, prevention and treatment of viral infection by Vaccinia virus. Specific functions, and accordingly utilities, of VGAM145 correlate with, and may be deduced from, the identity of the host target genes which VGAM145 binds and inhibits, and the function of these host target genes, as elaborated hereinbelow.

Nucleotide sequences of the VGAM145 precursor RNA, herein designated VGAM PRECURSOR RNA, and of the diced VGAM145 RNA, herein designated VGAM RNA, and a schematic representation of the secondary folding of VGAM145 folded precursor RNA, herein designated VGAM FOLDED PRECURSOR RNA, of VGAM145 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM145 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 146 (VGAM146) viral gene, which modulates expression of respective host target genes thereof, the function and utility of which host target genes is known in the art.

VGAM146 is a novel bioinformatically detected regulatory, non protein coding, viral micro RNA (miRNA) gene.

The method by which VGAM146 was detected is described hereinabove with reference to FIGS. 2-8.

VGAM146 gene, herein designated VGAM GENE, is a viral gene contained in the genome of Vaccinia virus. VGAM146 host target gene, herein designated VGAM HOST TARGET GENE, is a human gene contained in the human genome.

VGAM146 gene, herein designated VGAM GENE, encodes a VGAM146 precursor RNA, herein designated VGAM PRECURSOR RNA. Similar to other miRNA genes, and unlike most ordinary genes, VGAM146 precursor RNA, herein designated VGAM PRECURSOR RNA, does not encode a protein. A nucleotide sequence identical or highly similar to the nucleotide sequence of VGAM146 precursor RNA is designated SEQ ID:132, and is provided hereinbelow with reference to the sequence listing part. Nucleotide sequence SEQ ID:132 is located at position 69412 relative to the genome of Vaccinia virus.

VGAM146 precursor RNA, herein designated VGAM PRECURSOR RNA, folds onto itself, forming VGAM146 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM146 folded precursor RNA, herein designated VGAM FOLDED PRECURSOR RNA, into VGAM146 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM146 RNA is designated SEQ ID:481, and is provided hereinbelow with reference to the sequence listing part.

VGAM146 host target gene, herein designated VGAM HOST TARGET GENE, encodes a corresponding messenger RNA, VGAM146 host target RNA, herein designated VGAM HOST TARGET RNA. VGAM146 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM146 RNA, herein designated VGAM RNA, binds complementarily to one or more host target binding sites located in untranslated regions of VGAM146 host target RNA, herein designated VGAM HOST TARGET RNA. This complementary binding is due to the fact that the nucleotide sequence of VGAM146 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM146 RNA, herein designated VGAM RNA, may have a different number of host target binding sites in untranslated regions of a VGAM146 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM146 RNA, herein designated VGAM RNA, to host target binding sites on VGAM146 host target RNA, herein designated VGAM HOST TARGET RNA, such as BINDING SITE I, BINDING SITE II and BINDING SITE III, inhibits translation of VGAM146 host target RNA, herein designated VGAM HOST TARGET RNA, into VGAM146 host target protein, herein designated VGAM HOST TARGET PROTEIN. VGAM host target protein is therefore outlined by a broken line.

It is appreciated that VGAM146 host target gene, herein designated VGAM HOST TARGET GENE, in fact represents a plurality of VGAM146 host target genes. The mRNA of each one of this plurality of VGAM146 host target genes comprises one or more host target binding sites, each having a nucleotide sequence which is at least partly complementary to VGAM146 RNA, herein designated VGAM RNA, and which when bound by VGAM146 RNA, herein designated VGAM RNA, causes inhibition of translation of respective one or more VGAM146 host target proteins.

It is further appreciated by one skilled in the art that the mode of translational inhibition illustrated by FIG. 1 with specific reference to translational inhibition exerted by VGAM146 gene, herein designated VGAM GENE, on one or more VGAM146 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM146 is inhibition of expression of host target genes, as part of a novel viral mechanism of attacking a host. Accordingly, utilities of VGAM146 include diagnosis, prevention and treatment of viral infection by Vaccinia virus. Specific functions, and accordingly utilities, of VGAM146 correlate with, and may be deduced from, the identity of the host target genes which VGAM146 binds and inhibits, and the function of these host target genes, as elaborated hereinbelow.

Nucleotide sequences of the VGAM146 precursor RNA, herein designated VGAM PRECURSOR RNA, and of the diced VGAM146 RNA, herein designated VGAM RNA, and a schematic representation of the secondary folding of VGAM146 folded precursor RNA, herein designated VGAM FOLDED PRECURSOR RNA, of VGAM146 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM146 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 147 (VGAM147) viral gene, which modulates expression of respective host target genes thereof, the function and utility of which host target genes is known in the art.

VGAM147 is a novel bioinformatically detected regulatory, non protein coding, viral micro RNA (miRNA) gene. The method by which VGAM147 was detected is described hereinabove with reference to FIGS. 2-8.

VGAM147 gene, herein designated VGAM GENE, is a viral gene contained in the genome of Vaccinia virus. VGAM147 host target gene, herein designated VGAM HOST TARGET GENE, is a human gene contained in the human genome.

VGAM147 gene, herein designated VGAM GENE, encodes a VGAM147 precursor RNA, herein designated VGAM PRECURSOR RNA. Similar to other miRNA genes, and unlike most ordinary genes, VGAM147 precursor RNA, herein designated VGAM PRECURSOR RNA, does not encode a protein. A nucleotide sequence identical or highly similar to the nucleotide sequence of VGAM147 precursor RNA is designated SEQ ID:133, and is provided hereinbelow with reference to the sequence listing part. Nucleotide sequence SEQ ID:133 is located at position 66394 relative to the genome of Vaccinia virus.

VGAM147 precursor RNA, herein designated VGAM PRECURSOR RNA, folds onto itself, forming VGAM147 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM147 folded precursor RNA, herein designated VGAM FOLDED PRECURSOR RNA, into VGAM147 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 76%) nucleotide sequence of VGAM147 RNA is designated SEQ ID:482, and is provided hereinbelow with reference to the sequence listing part.

VGAM147 host target gene, herein designated VGAM HOST TARGET GENE, encodes a corresponding messenger RNA, VGAM147 host target RNA, herein designated VGAM HOST TARGET RNA. VGAM147 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM147 RNA, herein designated VGAM RNA, binds complementarily to one or more host target binding sites located in untranslated regions of VGAM147 host target RNA, herein designated VGAM HOST TARGET RNA. This complementary binding is due to the fact that the nucleotide sequence of VGAM147 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM147 RNA, herein designated VGAM RNA, may have a different number of host target binding sites in untranslated regions of a VGAM147 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM147 RNA, herein designated VGAM RNA, to host target binding sites on VGAM147 host target RNA, herein designated VGAM HOST TARGET RNA, such as BINDING SITE I, BINDING SITE II and BINDING SITE III, inhibits translation of VGAM147 host target RNA, herein designated VGAM HOST TARGET RNA, into VGAM147 host target protein, herein designated VGAM HOST TARGET PROTEIN. VGAM host target protein is therefore outlined by a broken line.

It is appreciated that VGAM147 host target gene, herein designated VGAM HOST TARGET GENE, in fact represents a plurality of VGAM147 host target genes. The mRNA of each one of this plurality of VGAM147 host target genes comprises one or more host target binding sites, each having a nucleotide sequence which is at least partly complementary to VGAM147 RNA, herein designated VGAM RNA, and which when bound by VGAM147 RNA, herein designated VGAM RNA, causes inhibition of translation of respective one or more VGAM147 host target proteins.

It is further appreciated by one skilled in the art that the mode of translational inhibition illustrated by FIG. 1 with specific reference to translational inhibition exerted by VGAM147 gene, herein designated VGAM GENE, on one or more VGAM147 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM147 is inhibition of expression of host target genes, as part of a novel viral mechanism of attacking a host. Accordingly, utilities of VGAM147 include diagnosis, prevention and treatment of viral infection by Vaccinia virus. Specific functions, and accordingly utilities, of VGAM147 correlate with, and may be deduced from, the identity of the host target genes which VGAM147 binds and inhibits, and the function of these host target genes, as elaborated hereinbelow.

Nucleotide sequences of the VGAM147 precursor RNA, herein designated VGAM PRECURSOR RNA, and of the diced VGAM147 RNA, herein designated VGAM RNA, and a schematic representation of the secondary folding of VGAM147 folded precursor RNA, herein designated VGAM FOLDED PRECURSOR RNA, of VGAM147 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM147 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 148 (VGAM148) viral gene, which modulates expression of respective host target genes thereof, the function and utility of which host target genes is known in the art.

VGAM148 is a novel bioinformatically detected regulatory, non protein coding, viral micro RNA (miRNA) gene. The method by which VGAM148 was detected is described hereinabove with reference to FIGS. 2-8.

VGAM148 gene, herein designated VGAM GENE, is a viral gene contained in the genome of Vaccinia virus. VGAM148 host target gene, herein designated VGAM HOST TARGET GENE, is a human gene contained in the human genome.

VGAM148 gene, herein designated VGAM GENE, encodes a VGAM148 precursor RNA, herein designated VGAM PRECURSOR RNA. Similar to other miRNA genes, and unlike most ordinary genes, VGAM148 precursor RNA, herein designated VGAM PRECURSOR RNA, does not encode a protein. A nucleotide sequence identical or highly similar to the nucleotide sequence of VGAM148 precursor RNA is designated SEQ ID:134, and is provided hereinbelow with reference to the sequence listing part. Nucleotide sequence SEQ ID:134 is located at position 72012 relative to the genome of Vaccinia virus.

VGAM148 precursor RNA, herein designated VGAM PRECURSOR RNA, folds onto itself, forming VGAM148 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM148 folded precursor RNA, herein designated VGAM FOLDED PRECURSOR RNA, into VGAM148 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 91%) nucleotide sequence of VGAM148 RNA is designated SEQ ID:483, and is provided hereinbelow with reference to the sequence listing part.

VGAM148 host target gene, herein designated VGAM HOST TARGET GENE, encodes a corresponding messenger RNA, VGAM148 host target RNA, herein designated VGAM HOST TARGET RNA. VGAM148 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM148 RNA, herein designated VGAM RNA, binds complementarily to one or more host target binding sites located in untranslated regions of VGAM148 host target RNA, herein designated VGAM HOST TARGET RNA. This complementary binding is due to the fact that the nucleotide sequence of VGAM148 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM148 RNA, herein designated VGAM RNA, may have a different number of host target binding sites in untranslated regions of a VGAM148 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM148 RNA, herein designated VGAM RNA, to host target binding sites on VGAM148 host target RNA, herein designated VGAM HOST TARGET RNA, such as BINDING SITE I, BINDING SITE II and BINDING SITE III, inhibits translation of VGAM148 host target RNA, herein designated VGAM HOST TARGET RNA, into VGAM148 host target protein, herein designated VGAM HOST TARGET PROTEIN. VGAM host target protein is therefore outlined by a broken line.

It is appreciated that VGAM148 host target gene, herein designated VGAM HOST TARGET GENE, in fact represents a plurality of VGAM148 host target genes. The mRNA of each one of this plurality of VGAM148 host target genes comprises one or more host target binding sites, each having a nucleotide sequence which is at least partly complementary to VGAM148 RNA, herein designated VGAM RNA, and which when bound by VGAM148 RNA, herein designated VGAM RNA, causes inhibition of translation of respective one or more VGAM148 host target proteins.

It is further appreciated by one skilled in the art that the mode of translational inhibition illustrated by FIG. 1 with specific reference to translational inhibition exerted by VGAM148 gene, herein designated VGAM GENE, on one or more VGAM148 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM148 is inhibition of expression of host target genes, as part of a novel viral mechanism of attacking a host. Accordingly, utilities of VGAM148 include diagnosis, prevention and treatment of viral infection by Vaccinia virus. Specific functions, and accordingly utilities, of VGAM148 correlate with, and may be deduced from, the identity of the host target genes which VGAM148 binds and inhibits, and the function of these host target genes, as elaborated hereinbelow.

Nucleotide sequences of the VGAM148 precursor RNA, herein designated VGAM PRECURSOR RNA, and of the diced VGAM148 RNA, herein designated VGAM RNA, and a schematic representation of the secondary folding of VGAM148 folded precursor RNA, herein designated VGAM FOLDED PRECURSOR RNA, of VGAM148 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM148 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 149 (VGAM149) viral gene, which modulates expression of respective host target genes thereof, the function and utility of which host target genes is known in the art.

VGAM149 is a novel bioinformatically detected regulatory, non protein coding, viral micro RNA (miRNA) gene. The method by which VGAM149 was detected is described hereinabove with reference to FIGS. 2-8.

VGAM149 gene, herein designated VGAM GENE, is a viral gene contained in the genome of Vaccinia virus. VGAM149 host target gene, herein designated VGAM HOST TARGET GENE, is a human gene contained in the human genome.

VGAM149 gene, herein designated VGAM GENE, encodes a VGAM149 precursor RNA, herein designated VGAM PRECURSOR RNA. Similar to other miRNA genes, and unlike most ordinary genes, VGAM149 precursor RNA, herein designated VGAM PRECURSOR RNA, does not encode a protein. A nucleotide sequence identical or highly similar to the nucleotide sequence of VGAM149 precursor RNA is designated SEQ ID:135, and is provided hereinbelow with reference to the sequence listing part. Nucleotide sequence SEQ ID:135 is located at position 71497 relative to the genome of Vaccinia virus.

VGAM149 precursor RNA, herein designated VGAM PRECURSOR RNA, folds onto itself, forming VGAM149 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM149 folded precursor RNA, herein designated VGAM FOLDED PRECURSOR RNA, into VGAM149 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 71%) nucleotide sequence of VGAM149 RNA is designated SEQ ID:484, and is provided hereinbelow with reference to the sequence listing part.

VGAM149 host target gene, herein designated VGAM HOST TARGET GENE, encodes a corresponding messenger RNA, VGAM149 host target RNA, herein designated VGAM HOST TARGET RNA. VGAM149 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM149 RNA, herein designated VGAM RNA, binds complementarily to one or more host target binding sites located in untranslated regions of VGAM149 host target RNA, herein designated VGAM HOST TARGET RNA. This complementary binding is due to the fact that the nucleotide sequence of VGAM149 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM149 RNA, herein designated VGAM RNA, may have a different number of host target binding sites in untranslated regions of a VGAM149 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM149 RNA, herein designated VGAM RNA, to host target binding sites on VGAM149 host target RNA, herein designated VGAM HOST TARGET RNA, such as BINDING SITE I, BINDING SITE II and BINDING SITE III, inhibits translation of VGAM149 host target RNA, herein designated VGAM HOST TARGET RNA, into VGAM149 host target protein, herein designated VGAM HOST TARGET PROTEIN. VGAM host target protein is therefore outlined by a broken line.

It is appreciated that VGAM149 host target gene, herein designated VGAM HOST TARGET GENE, in fact represents a plurality of VGAM149 host target genes. The mRNA of each one of this plurality of VGAM149 host target genes comprises one or more host target binding sites, each having a nucleotide sequence which is at least partly complementary to VGAM149 RNA, herein designated VGAM RNA, and which when bound by VGAM149 RNA, herein designated VGAM RNA, causes inhibition of translation of respective one or more VGAM149 host target proteins.

It is further appreciated by one skilled in the art that the mode of translational inhibition illustrated by FIG. 1 with specific reference to translational inhibition exerted by VGAM149 gene, herein designated VGAM GENE, on one or more VGAM149 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM149 is inhibition of expression of host target genes, as part of a novel viral mechanism of attacking a host. Accordingly, utilities of VGAM149 include diagnosis, prevention and treatment of viral infection by Vaccinia virus. Specific functions, and accordingly utilities, of VGAM149 correlate with, and may be deduced from, the identity of the host target genes which VGAM149 binds and inhibits, and the function of these host target genes, as elaborated hereinbelow.

Nucleotide sequences of the VGAM149 precursor RNA, herein designated VGAM PRECURSOR RNA, and of the diced VGAM149 RNA, herein designated VGAM RNA, and a schematic representation of the secondary folding of VGAM149 folded precursor RNA, herein designated VGAM FOLDED PRECURSOR RNA, of VGAM149 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM149 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 150 (VGAM150) viral gene, which modulates expression of respective host target genes thereof, the function and utility of which host target genes is known in the art.

VGAM150 is a novel bioinformatically detected regulatory, non protein coding, viral micro RNA (miRNA) gene. The method by which VGAM150 was detected is described hereinabove with reference to FIGS. 2-8.

VGAM150 gene, herein designated VGAM GENE, is a viral gene contained in the genome of Vaccinia virus. VGAM150 host target gene, herein designated VGAM HOST TARGET GENE, is a human gene contained in the human genome.

VGAM150 gene, herein designated VGAM GENE, encodes a VGAM150 precursor RNA, herein designated VGAM PRECURSOR RNA. Similar to other miRNA genes, and unlike most ordinary genes, VGAM150 precursor RNA, herein designated VGAM PRECURSOR RNA, does not encode a protein. A nucleotide sequence identical or highly similar to the nucleotide sequence of VGAM150 precursor RNA is designated SEQ ID:136, and is provided hereinbelow with reference to the sequence listing part. Nucleotide sequence SEQ ID:136 is located at position 73985 relative to the genome of Vaccinia virus.

VGAM150 precursor RNA, herein designated VGAM PRECURSOR RNA, folds onto itself, forming VGAM150 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM150 folded precursor RNA, herein designated VGAM FOLDED PRECURSOR RNA, into VGAM150 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 93%) nucleotide sequence of VGAM150 RNA is designated SEQ ID:485, and is provided hereinbelow with reference to the sequence listing part.

VGAM150 host target gene, herein designated VGAM HOST TARGET GENE, encodes a corresponding messenger RNA, VGAM150 host target RNA, herein designated VGAM HOST TARGET RNA. VGAM150 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM150 RNA, herein designated VGAM RNA, binds complementarily to one or more host target binding sites located in untranslated regions of VGAM150 host target RNA, herein designated VGAM HOST TARGET RNA. This complementary binding is due to the fact that the nucleotide sequence of VGAM150 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM150 RNA, herein designated VGAM RNA, may have a different number of host target binding sites in untranslated regions of a VGAM150 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM150 RNA, herein designated VGAM RNA, to host target binding sites on VGAM150 host target RNA, herein designated VGAM HOST TARGET RNA, such as BINDING SITE I, BINDING SITE II and BINDING SITE III, inhibits translation of VGAM150 host target RNA, herein designated VGAM HOST TARGET RNA, into VGAM150 host target protein, herein designated VGAM HOST TARGET PROTEIN. VGAM host target protein is therefore outlined by a broken line.

It is appreciated that VGAM150 host target gene, herein designated VGAM HOST TARGET GENE, in fact represents a plurality of VGAM150 host target genes. The mRNA of each one of this plurality of VGAM150 host target genes comprises one or more host target binding sites, each having a nucleotide sequence which is at least partly complementary to VGAM150 RNA, herein designated VGAM RNA, and which when bound by VGAM150 RNA, herein designated VGAM RNA, causes inhibition of translation of respective one or more VGAM150 host target proteins.

It is further appreciated by one skilled in the art that the mode of translational inhibition illustrated by FIG. 1 with specific reference to translational inhibition exerted by VGAM150 gene, herein designated VGAM GENE, on one or more VGAM150 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM150 is inhibition of expression of host target genes, as part of a novel viral mechanism of attacking a host. Accordingly, utilities of VGAM150 include diagnosis, prevention and treatment of viral infection by Vaccinia virus. Specific functions, and accordingly utilities, of VGAM150 correlate with, and may be deduced from, the identity of the host target genes which VGAM150 binds and inhibits, and the function of these host target genes, as elaborated hereinbelow.

Nucleotide sequences of the VGAM150 precursor RNA, herein designated VGAM PRECURSOR RNA, and of the diced VGAM150 RNA, herein designated VGAM RNA, and a schematic representation of the secondary folding of VGAM150 folded precursor RNA, herein designated VGAM FOLDED PRECURSOR RNA, of VGAM150 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM150 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 151 (VGAM151) viral gene, which modulates expression of respective host target genes thereof, the function and utility of which host target genes is known in the art.

VGAM151 is a novel bioinformatically detected regulatory, non protein coding, viral micro RNA (miRNA) gene. The method by which VGAM151 was detected is described hereinabove with reference to FIGS. 2-8.

VGAM151 gene, herein designated VGAM GENE, is a viral gene contained in the genome of Vaccinia virus. VGAM151 host target gene, herein designated VGAM HOST TARGET GENE, is a human gene contained in the human genome.

VGAM151 gene, herein designated VGAM GENE, encodes a VGAM151 precursor RNA, herein designated VGAM PRECURSOR RNA. Similar to other miRNA genes, and unlike most ordinary genes, VGAM151 precursor RNA, herein designated VGAM PRECURSOR RNA, does not encode a protein. A nucleotide sequence identical or highly similar to the nucleotide sequence of VGAM151 precursor RNA is designated SEQ ID:137, and is provided hereinbelow with reference to the sequence listing part. Nucleotide sequence SEQ ID:137 is located at position 72599 relative to the genome of Vaccinia virus.

VGAM151 precursor RNA, herein designated VGAM PRECURSOR RNA, folds onto itself, forming VGAM151 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM151 folded precursor RNA, herein designated VGAM FOLDED PRECURSOR RNA, into VGAM151 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 89%) nucleotide sequence of VGAM151 RNA is designated SEQ ID:486, and is provided hereinbelow with reference to the sequence listing part.

VGAM151 host target gene, herein designated VGAM HOST TARGET GENE, encodes a corresponding messenger RNA, VGAM151 host target RNA, herein designated VGAM HOST TARGET RNA. VGAM151 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM151 RNA, herein designated VGAM RNA, binds complementarily to one or more host target binding sites located in untranslated regions of VGAM151 host target RNA, herein designated VGAM HOST TARGET RNA. This complementary binding is due to the fact that the nucleotide sequence of VGAM151 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM151 RNA, herein designated VGAM RNA, may have a different number of host target binding sites in untranslated regions of a VGAM151 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM151 RNA, herein designated VGAM RNA, to host target binding sites on VGAM151 host target RNA, herein designated VGAM HOST TARGET RNA, such as BINDING SITE I, BINDING SITE II and BINDING SITE III, inhibits translation of VGAM151 host target RNA, herein designated VGAM HOST TARGET RNA, into VGAM151 host target protein, herein designated VGAM HOST TARGET PROTEIN. VGAM host target protein is therefore outlined by a broken line.

It is appreciated that VGAM151 host target gene, herein designated VGAM HOST TARGET GENE, in fact represents a plurality of VGAM151 host target genes. The mRNA of each one of this plurality of VGAM151 host target genes comprises one or more host target binding sites, each having a nucleotide sequence which is at least partly complementary to VGAM151 RNA, herein designated VGAM RNA, and which when bound by VGAM151 RNA, herein designated VGAM RNA, causes inhibition of translation of respective one or more VGAM151 host target proteins.

It is further appreciated by one skilled in the art that the mode of translational inhibition illustrated by FIG. 1 with specific reference to translational inhibition exerted by VGAM151 gene, herein designated VGAM GENE, on one or more VGAM151 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM151 is inhibition of expression of host target genes, as part of a novel viral mechanism of attacking a host. Accordingly, utilities of VGAM151 include diagnosis, prevention and treatment of viral infection by Vaccinia virus. Specific functions, and accordingly utilities, of VGAM151 correlate with, and may be deduced from, the identity of the host target genes which VGAM151 binds and inhibits, and the function of these host target genes, as elaborated hereinbelow.

Nucleotide sequences of the VGAM151 precursor RNA, herein designated VGAM PRECURSOR RNA, and of the diced VGAM151 RNA, herein designated VGAM RNA, and a schematic representation of the secondary folding of VGAM151 folded precursor RNA, herein designated VGAM FOLDED PRECURSOR RNA, of VGAM151 are further described hereinbelow with reference to Table 1.

Nucleotide sequences of host target binding sites, such as BINDING SITE-I, BINDING SITE-II and BINDING SITE- III of FIG. 1, found on, and schematic representation of the complementarity of each of these host target binding sites to VGAM151 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 152 (VGAM152) viral gene, which modulates expression of respective host target genes thereof, the function and utility of which host target genes is known in the art.

VGAM152 is a novel bioinformatically detected regulatory, non protein coding, viral micro RNA (miRNA) gene. The method by which VGAM152 was detected is described hereinabove with reference to FIGS. 2-8.

VGAM152 gene, herein designated VGAM GENE, is a viral gene contained in the genome of Vaccinia virus. VGAM152 host target gene, herein designated VGAM HOST TARGET GENE, is a human gene contained in the human genome.

VGAM152 gene, herein designated VGAM GENE, encodes a VGAM152 precursor RNA, herein designated VGAM PRECURSOR RNA. Similar to other miRNA genes, and unlike most ordinary genes, VGAM152 precursor RNA, herein designated VGAM PRECURSOR RNA, does not encode a protein. A nucleotide sequence identical or highly similar to the nucleotide sequence of VGAM152 precursor RNA is designated SEQ ID:138, and is provided hereinbelow with reference to the sequence listing part. Nucleotide sequence SEQ ID:138 is located at position 74425 relative to the genome of Vaccinia virus.

VGAM152 precursor RNA, herein designated VGAM PRECURSOR RNA, folds onto itself, forming VGAM152 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM152 folded precursor RNA, herein designated VGAM FOLDED PRECURSOR RNA, into VGAM152 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM152 RNA is designated SEQ ID:487, and is provided hereinbelow with reference to the sequence listing part.

VGAM152 host target gene, herein designated VGAM HOST TARGET GENE, encodes a corresponding messenger RNA, VGAM152 host target RNA, herein designated VGAM HOST TARGET RNA. VGAM152 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM152 RNA, herein designated VGAM RNA, binds complementarily to one or more host target binding sites located in untranslated regions of VGAM152 host target RNA, herein designated VGAM HOST TARGET RNA. This complementary binding is due to the fact that the nucleotide sequence of VGAM152 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM152 RNA, herein designated VGAM RNA, may have a different number of host target binding sites in untranslated regions of a VGAM152 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM152 RNA, herein designated VGAM RNA, to host target binding sites on VGAM152 host target RNA, herein designated VGAM HOST TARGET RNA, such as BINDING SITE I, BINDING SITE II and BINDING SITE III, inhibits translation of VGAM152 host target RNA, herein designated VGAM HOST TARGET RNA, into VGAM152 host target protein, herein designated VGAM HOST TARGET PROTEIN. VGAM host target protein is therefore outlined by a broken line.

It is appreciated that VGAM152 host target gene, herein designated VGAM HOST TARGET GENE, in fact represents a plurality of VGAM152 host target genes. The mRNA of each one of this plurality of VGAM152 host target genes comprises one or more host target binding sites, each having a nucleotide sequence which is at least partly complementary to VGAM152 RNA, herein designated VGAM RNA, and which when bound by VGAM152 RNA, herein designated VGAM RNA, causes inhibition of translation of respective one or more VGAM152 host target proteins.

It is further appreciated by one skilled in the art that the mode of translational inhibition illustrated by FIG. 1 with specific reference to translational inhibition exerted by VGAM152 gene, herein designated VGAM GENE, on one or more VGAM152 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM152 is inhibition of expression of host target genes, as part of a novel viral mechanism of attacking a host. Accordingly, utilities of VGAM152 include diagnosis, prevention and treatment of viral infection by Vaccinia virus. Specific functions, and accordingly utilities, of VGAM152 correlate with, and may be deduced from, the identity of the host target genes which VGAM152 binds and inhibits, and the function of these host target genes, as elaborated hereinbelow.

Nucleotide sequences of the VGAM152 precursor RNA, herein designated VGAM PRECURSOR RNA, and of the diced VGAM152 RNA, herein designated VGAM RNA, and a schematic representation of the secondary folding of VGAM152 folded precursor RNA, herein designated VGAM FOLDED PRECURSOR RNA, of VGAM152 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM152 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 153 (VGAM153) viral gene, which modulates expression of respective host target genes thereof, the function and utility of which host target genes is known in the art.

VGAM153 is a novel bioinformatically detected regulatory, non protein coding, viral micro RNA (miRNA) gene. The method by which VGAM153 was detected is described hereinabove with reference to FIGS. 2-8.

VGAM153 gene, herein designated VGAM GENE, is a viral gene contained in the genome of Vaccinia virus. VGAM153 host target gene, herein designated VGAM HOST TARGET GENE, is a human gene contained in the human genome.

VGAM153 gene, herein designated VGAM GENE, encodes a VGAM153 precursor RNA, herein designated VGAM PRECURSOR RNA. Similar to other miRNA genes, and unlike most ordinary genes, VGAM153 precursor RNA, herein designated VGAM PRECURSOR RNA, does not encode a protein. A nucleotide sequence identical or highly similar to the nucleotide sequence of VGAM153 precursor RNA is designated SEQ ID:139, and is provided hereinbelow with reference to the sequence listing part. Nucleotide sequence SEQ ID:139 is located at position 74889 relative to the genome of Vaccinia virus.

VGAM153 precursor RNA, herein designated VGAM PRECURSOR RNA, folds onto itself, forming VGAM153 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM153 folded precursor RNA, herein designated VGAM FOLDED PRECURSOR RNA, into VGAM153 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 76%) nucleotide sequence of VGAM153 RNA is designated SEQ ID:488, and is provided hereinbelow with reference to the sequence listing part.

VGAM153 host target gene, herein designated VGAM HOST TARGET GENE, encodes a corresponding messenger RNA, VGAM153 host target RNA, herein designated VGAM HOST TARGET RNA. VGAM153 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM153 RNA, herein designated VGAM RNA, binds complementarily to one or more host target binding sites located in untranslated regions of VGAM153 host target RNA, herein designated VGAM HOST TARGET RNA. This complementary binding is due to the fact that the nucleotide sequence of VGAM153 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM153 RNA, herein designated VGAM RNA, may have a different number of host target binding sites in untranslated regions of a VGAM153 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM153 RNA, herein designated VGAM RNA, to host target binding sites on VGAM153 host target RNA, herein designated VGAM HOST TARGET RNA, such as BINDING SITE I, BINDING SITE II and BINDING SITE III, inhibits translation of VGAM153 host target RNA, herein designated VGAM HOST TARGET RNA, into VGAM153 host target protein, herein designated VGAM HOST TARGET PROTEIN. VGAM host target protein is therefore outlined by a broken line.

It is appreciated that VGAM153 host target gene, herein designated VGAM HOST TARGET GENE, in fact represents a plurality of VGAM153 host target genes. The mRNA of each one of this plurality of VGAM153 host target genes comprises one or more host target binding sites, each having a nucleotide sequence which is at least partly complementary to VGAM153 RNA, herein designated VGAM RNA, and which when bound by VGAM153 RNA, herein designated VGAM RNA, causes inhibition of translation of respective one or more VGAM153 host target proteins.

It is further appreciated by one skilled in the art that the mode of translational inhibition illustrated by FIG. 1 with specific reference to translational inhibition exerted by VGAM153 gene, herein designated VGAM GENE, on one or more VGAM153 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM153 is inhibition of expression of host target genes, as part of a novel viral mechanism of attacking a host. Accordingly, utilities of VGAM153 include diagnosis, prevention and treatment of viral infection by Vaccinia virus. Specific functions, and accordingly utilities, of VGAM153 correlate with, and may be deduced from, the identity of the host target genes which VGAM153 binds and inhibits, and the function of these host target genes, as elaborated hereinbelow.

Nucleotide sequences of the VGAM153 precursor RNA, herein designated VGAM PRECURSOR RNA, and of the diced VGAM153 RNA, herein designated VGAM RNA, and a schematic representation of the secondary folding of VGAM153 folded precursor RNA, herein designated VGAM FOLDED PRECURSOR RNA, of VGAM153 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM153 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 154 (VGAM154) viral gene, which modulates expression of respective host target genes thereof, the function and utility of which host target genes is known in the art.

VGAM154 is a novel bioinformatically detected regulatory, non protein coding, viral micro RNA (miRNA) gene. The method by which VGAM154 was detected is described hereinabove with reference to FIGS. 2-8.

VGAM154 gene, herein designated VGAM GENE, is a viral gene contained in the genome of Vaccinia virus. VGAM154 host target gene, herein designated VGAM HOST TARGET GENE, is a human gene contained in the human genome.

VGAM154 gene, herein designated VGAM GENE, encodes a VGAM154 precursor RNA, herein designated VGAM PRECURSOR RNA. Similar to other miRNA genes, and unlike most ordinary genes, VGAM154 precursor RNA, herein designated VGAM PRECURSOR RNA, does not encode a protein. A nucleotide sequence identical or highly similar to the nucleotide sequence of VGAM154 precursor RNA is designated SEQ ID:140, and is provided hereinbelow with reference to the sequence listing part. Nucleotide sequence SEQ ID: 140 is located at position 80970 relative to the genome of Vaccinia virus.

VGAM154 precursor RNA, herein designated VGAM PRECURSOR RNA, folds onto itself, forming VGAM154 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM154 folded precursor RNA, herein designated VGAM FOLDED PRECURSOR RNA, into VGAM154 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 88%) nucleotide sequence of VGAM154 RNA is designated SEQ ID:489, and is provided hereinbelow with reference to the sequence listing part.

VGAM154 host target gene, herein designated VGAM HOST TARGET GENE, encodes a corresponding messenger RNA, VGAM154 host target RNA, herein designated VGAM HOST TARGET RNA. VGAM154 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM154 RNA, herein designated VGAM RNA, binds complementarily to one or more host target binding sites located in untranslated regions of VGAM154 host target RNA, herein designated VGAM HOST TARGET RNA. This complementary binding is due to the fact that the nucleotide sequence of VGAM154 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM154 RNA, herein designated VGAM RNA, may have a different number of host target binding sites in untranslated regions of a VGAM154 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM154 RNA, herein designated VGAM RNA, to host target binding sites on VGAM154 host target RNA, herein designated VGAM HOST TARGET RNA, such as BINDING SITE I, BINDING SITE II and BINDING SITE III, inhibits translation of VGAM154 host target RNA, herein designated VGAM HOST TARGET RNA, into VGAM154 host target protein, herein designated VGAM HOST TARGET PROTEIN. VGAM host target protein is therefore outlined by a broken line.

It is appreciated that VGAM154 host target gene, herein designated VGAM HOST TARGET GENE, in fact represents a plurality of VGAM154 host target genes. The mRNA of each one of this plurality of VGAM154 host target genes comprises one or more host target binding sites, each having a nucleotide sequence which is at least partly complementary to VGAM154 RNA, herein designated VGAM RNA, and which when bound by VGAM154 RNA, herein designated VGAM RNA, causes inhibition of translation of respective one or more VGAM154 host target proteins.

It is further appreciated by one skilled in the art that the mode of translational inhibition illustrated by FIG. 1 with specific reference to translational inhibition exerted by VGAM154 gene, herein designated VGAM GENE, on one or more VGAM154 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM154 is inhibition of expression of host target genes, as part of a novel viral mechanism of attacking a host. Accordingly, utilities of VGAM154 include diagnosis, prevention and treatment of viral infection by Vaccinia virus. Specific functions, and accordingly utilities, of VGAM154 correlate with, and may be deduced from, the identity of the host target genes which VGAM154 binds and inhibits, and the function of these host target genes, as elaborated hereinbelow.

Nucleotide sequences of the VGAM154 precursor RNA, herein designated VGAM PRECURSOR RNA, and of the diced VGAM154 RNA, herein designated VGAM RNA, and a schematic representation of the secondary folding of VGAM154 folded precursor RNA, herein designated VGAM FOLDED PRECURSOR RNA, of VGAM154 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM154 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 155 (VGAM155) viral gene, which modulates expression of respective host target genes thereof, the function and utility of which host target genes is known in the art.

VGAM155 is a novel bioinformatically detected regulatory, non protein coding, viral micro RNA (miRNA) gene. The method by which VGAM155 was detected is described hereinabove with reference to FIGS. 2-8.

VGAM155 gene, herein designated VGAM GENE, is a viral gene contained in the genome of Vaccinia virus. VGAM155 host target gene, herein designated VGAM HOST TARGET GENE, is a human gene contained in the human genome.

VGAM155 gene, herein designated VGAM GENE, encodes a VGAM155 precursor RNA, herein designated VGAM PRECURSOR RNA. Similar to other miRNA genes, and unlike most ordinary genes, VGAM155 precursor RNA, herein designated VGAM PRECURSOR RNA, does not encode a protein. A nucleotide sequence identical or highly similar to the nucleotide sequence of VGAM155 precursor RNA is designated SEQ ID:141, and is provided hereinbelow with reference to the sequence listing part. Nucleotide sequence SEQ ID: 141 is located at position 80298 relative to the genome of Vaccinia virus.

VGAM155 precursor RNA, herein designated VGAM PRECURSOR RNA, folds onto itself, forming VGAM155 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM155 folded precursor RNA, herein designated VGAM FOLDED PRECURSOR RNA, into VGAM155 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 88%) nucleotide sequence of VGAM155 RNA is designated SEQ ID:490, and is provided hereinbelow with reference to the sequence listing part.

VGAM155 host target gene, herein designated VGAM HOST TARGET GENE, encodes a corresponding messenger RNA, VGAM155 host target RNA, herein designated VGAM HOST TARGET RNA. VGAM155 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM155 RNA, herein designated VGAM RNA, binds complementarily to one or more host target binding sites located in untranslated regions of VGAM155 host target RNA, herein designated VGAM HOST TARGET RNA. This complementary binding is due to the fact that the nucleotide sequence of VGAM155 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM155 RNA, herein designated VGAM RNA, may have a different number of host target binding sites in untranslated regions of a VGAM155 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM155 RNA, herein designated VGAM RNA, to host target binding sites on VGAM155 host target RNA, herein designated VGAM HOST TARGET RNA, such as BINDING SITE I, BINDING SITE II and BINDING SITE III, inhibits translation of VGAM155 host target RNA, herein designated VGAM HOST TARGET RNA, into VGAM155 host target protein, herein designated VGAM HOST TARGET PROTEIN. VGAM host target protein is therefore outlined by a broken line.

It is appreciated that VGAM155 host target gene, herein designated VGAM HOST TARGET GENE, in fact represents a plurality of VGAM155 host target genes. The mRNA of each one of this plurality of VGAM155 host target genes comprises one or more host target binding sites, each having a nucleotide sequence which is at least partly complementary to VGAM155 RNA, herein designated VGAM RNA, and which when bound by VGAM155 RNA, herein designated VGAM RNA, causes inhibition of translation of respective one or more VGAM155 host target proteins.

It is further appreciated by one skilled in the art that the mode of translational inhibition illustrated by FIG. 1 with specific reference to translational inhibition exerted by VGAM155 gene, herein designated VGAM GENE, on one or more VGAM155 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM155 is inhibition of expression of host target genes, as part of a novel viral mechanism of attacking a host. Accordingly, utilities of VGAM155 include diagnosis, prevention and treatment of viral infection by Vaccinia virus. Specific functions, and accordingly utilities, of VGAM155 correlate with, and may be deduced from, the identity of the host target genes which VGAM155 binds and inhibits, and the function of these host target genes, as elaborated hereinbelow.

Nucleotide sequences of the VGAM155 precursor RNA, herein designated VGAM PRECURSOR RNA, and of the diced VGAM155 RNA, herein designated VGAM RNA, and a schematic representation of the secondary folding of VGAM155 folded precursor RNA, herein designated VGAM FOLDED PRECURSOR RNA, of VGAM155 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM155 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 156 (VGAM156) viral gene, which modulates expression of respective host target genes thereof, the function and utility of which host target genes is known in the art.

VGAM156 is a novel bioinformatically detected regulatory, non protein coding, viral micro RNA (miRNA) gene. The method by which VGAM156 was detected is described hereinabove with reference to FIGS. 2-8.

VGAM156 gene, herein designated VGAM GENE, is a viral gene contained in the genome of Vaccinia virus. VGAM156 host target gene, herein designated VGAM HOST TARGET GENE, is a human gene contained in the human genome.

VGAM156 gene, herein designated VGAM GENE, encodes a VGAM156 precursor RNA, herein designated VGAM PRECURSOR RNA. Similar to other miRNA genes, and unlike most ordinary genes, VGAM156 precursor RNA, herein designated VGAM PRECURSOR RNA, does not encode a protein. A nucleotide sequence identical or highly similar to the nucleotide sequence of VGAM156 precursor RNA is designated SEQ ID:142, and is provided hereinbelow with reference to the sequence listing part. Nucleotide sequence SEQ ID: 142 is located at position 79822 relative to the genome of Vaccinia virus.

VGAM156 precursor RNA, herein designated VGAM PRECURSOR RNA, folds onto itself, forming VGAM156 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM156 folded precursor RNA, herein designated VGAM FOLDED PRECURSOR RNA, into VGAM156 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM156 RNA is designated SEQ ID:491, and is provided hereinbelow with reference to the sequence listing part.

VGAM156 host target gene, herein designated VGAM HOST TARGET GENE, encodes a corresponding messenger RNA, VGAM156 host target RNA, herein designated VGAM HOST TARGET RNA. VGAM156 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM156 RNA, herein designated VGAM RNA, binds complementarily to one or more host target binding sites located in untranslated regions of VGAM156 host target RNA, herein designated VGAM HOST TARGET RNA. This complementary binding is due to the fact that the nucleotide sequence of VGAM156 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM156 RNA, herein designated VGAM RNA, may have a different number of host target binding sites in untranslated regions of a VGAM156 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM156 RNA, herein designated VGAM RNA, to host target binding sites on VGAM156 host target RNA, herein designated VGAM HOST TARGET RNA, such as BINDING SITE I, BINDING SITE II and BINDING SITE III, inhibits translation of VGAM156 host target RNA, herein designated VGAM HOST TARGET RNA, into VGAM156 host target protein, herein designated VGAM HOST TARGET PROTEIN. VGAM host target protein is therefore outlined by a broken line.

It is appreciated that VGAM156 host target gene, herein designated VGAM HOST TARGET GENE, in fact represents a plurality of VGAM156 host target genes. The mRNA of each one of this plurality of VGAM156 host target genes comprises one or more host target binding sites, each having a nucleotide sequence which is at least partly complementary to VGAM156 RNA, herein designated VGAM RNA, and which when bound by VGAM156 RNA, herein designated VGAM RNA, causes inhibition of translation of respective one or more VGAM156 host target proteins.

It is further appreciated by one skilled in the art that the mode of translational inhibition illustrated by FIG. 1 with specific reference to translational inhibition exerted by VGAM156 gene, herein designated VGAM GENE, on one or more VGAM156 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM156 is inhibition of expression of host target genes, as part of a novel viral mechanism of attacking a host. Accordingly, utilities of VGAM156 include diagnosis, prevention and treatment of viral infection by Vaccinia virus. Specific functions, and accordingly utilities, of VGAM156 correlate with, and may be deduced from, the identity of the host target genes which VGAM156 binds and inhibits, and the function of these host target genes, as elaborated hereinbelow.

Nucleotide sequences of the VGAM156 precursor RNA, herein designated VGAM PRECURSOR RNA, and of the diced VGAM156 RNA, herein designated VGAM RNA, and a schematic representation of the secondary folding of VGAM156 folded precursor RNA, herein designated VGAM FOLDED PRECURSOR RNA, of VGAM156 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM156 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 157 (VGAM157) viral gene, which modulates expression of respective host target genes thereof, the function and utility of which host target genes is known in the art.

VGAM157 is a novel bioinformatically detected regulatory, non protein coding, viral micro RNA (miRNA) gene. The method by which VGAM157 was detected is described hereinabove with reference to FIGS. 2-8.

VGAM157 gene, herein designated VGAM GENE, is a viral gene contained in the genome of Vaccinia virus. VGAM157 host target gene, herein designated VGAM HOST TARGET GENE, is a human gene contained in the human genome.

VGAM157 gene, herein designated VGAM GENE, encodes a VGAM157 precursor RNA, herein designated VGAM PRECURSOR RNA. Similar to other miRNA genes, and unlike most ordinary genes, VGAM157 precursor RNA, herein designated VGAM PRECURSOR RNA, does not encode a protein. A nucleotide sequence identical or highly similar to the nucleotide sequence of VGAM157 precursor RNA is designated SEQ ID:143, and is provided hereinbelow with reference to the sequence listing part. Nucleotide sequence SEQ ID:143 is located at position 79119 relative to the genome of Vaccinia virus.

VGAM157 precursor RNA, herein designated VGAM PRECURSOR RNA, folds onto itself, forming VGAM157 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM157 folded precursor RNA, herein designated VGAM FOLDED PRECURSOR RNA, into VGAM157 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 70%) nucleotide sequence of VGAM157 RNA is designated SEQ ID:492, and is provided hereinbelow with reference to the sequence listing part.

VGAM157 host target gene, herein designated VGAM HOST TARGET GENE, encodes a corresponding messenger RNA, VGAM157 host target RNA, herein designated VGAM HOST TARGET RNA. VGAM157 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM157 RNA, herein designated VGAM RNA, binds complementarily to one or more host target binding sites located in untranslated regions of VGAM157 host target RNA, herein designated VGAM HOST TARGET RNA. This complementary binding is due to the fact that the nucleotide sequence of VGAM157 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM157 RNA, herein designated VGAM RNA, may have a different number of host target binding sites in untranslated regions of a VGAM157 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM157 RNA, herein designated VGAM RNA, to host target binding sites on VGAM157 host target RNA, herein designated VGAM HOST TARGET RNA, such as BINDING SITE I, BINDING SITE II and BINDING SITE III, inhibits translation of VGAM157 host target RNA, herein designated VGAM HOST TARGET RNA, into VGAM157 host target protein, herein designated VGAM HOST TARGET PROTEIN. VGAM host target protein is therefore outlined by a broken line.

It is appreciated that VGAM157 host target gene, herein designated VGAM HOST TARGET GENE, in fact represents a plurality of VGAM157 host target genes. The mRNA of each one of this plurality of VGAM157 host target genes comprises one or more host target binding sites, each having a nucleotide sequence which is at least partly complementary to VGAM157 RNA, herein designated VGAM RNA, and which when bound by VGAM157 RNA, herein designated VGAM RNA, causes inhibition of translation of respective one or more VGAM157 host target proteins.

It is further appreciated by one skilled in the art that the mode of translational inhibition illustrated by FIG. 1 with specific reference to translational inhibition exerted by VGAM157 gene, herein designated VGAM GENE, on one or more VGAM157 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM157 is inhibition of expression of host target genes, as part of a novel viral mechanism of attacking a host. Accordingly, utilities of VGAM157 include diagnosis, prevention and treatment of viral infection by Vaccinia virus. Specific functions, and accordingly utilities, of VGAM157 correlate with, and may be deduced from, the identity of the host target genes which VGAM157 binds and inhibits, and the function of these host target genes, as elaborated hereinbelow.

Nucleotide sequences of the VGAM157 precursor RNA, herein designated VGAM PRECURSOR RNA, and of the diced VGAM157 RNA, herein designated VGAM RNA, and a schematic representation of the secondary folding of VGAM157 folded precursor RNA, herein designated VGAM FOLDED PRECURSOR RNA, of VGAM157 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM157 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 158 (VGAM158) viral gene, which modulates expression of respective host target genes thereof, the function and utility of which host target genes is known in the art.

VGAM158 is a novel bioinformatically detected regulatory, non protein coding, viral micro RNA (miRNA) gene. The method by which VGAM158 was detected is described hereinabove with reference to FIGS. 2-8.

VGAM158 gene, herein designated VGAM GENE, is a viral gene contained in the genome of Vaccinia virus. VGAM158 host target gene, herein designated VGAM HOST TARGET GENE, is a human gene contained in the human genome.

VGAM158 gene, herein designated VGAM GENE, encodes a VGAM158 precursor RNA, herein designated VGAM PRECURSOR RNA. Similar to other miRNA genes, and unlike most ordinary genes, VGAM158 precursor RNA, herein designated VGAM PRECURSOR RNA, does not encode a protein. A nucleotide sequence identical or highly similar to the nucleotide sequence of VGAM158 precursor RNA is designated SEQ ID:144, and is provided hereinbelow with reference to the sequence listing part. Nucleotide sequence SEQ ID:144 is located at position 81571 relative to the genome of Vaccinia virus.

VGAM158 precursor RNA, herein designated VGAM PRECURSOR RNA, folds onto itself, forming VGAM158 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM158 folded precursor RNA, herein designated VGAM FOLDED PRECURSOR RNA, into VGAM158 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM158 RNA is designated SEQ ID:493, and is provided hereinbelow with reference to the sequence listing part.

VGAM158 host target gene, herein designated VGAM HOST TARGET GENE, encodes a corresponding messenger RNA, VGAM158 host target RNA, herein designated VGAM HOST TARGET RNA. VGAM158 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM158 RNA, herein designated VGAM RNA, binds complementarily to one or more host target binding sites located in untranslated regions of VGAM158 host target RNA, herein designated VGAM HOST TARGET RNA. This complementary binding is due to the fact that the nucleotide sequence of VGAM158 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM158 RNA, herein designated VGAM RNA, may have a different number of host target binding sites in untranslated regions of a VGAM158 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM158 RNA, herein designated VGAM RNA, to host target binding sites on VGAM158 host target RNA, herein designated VGAM HOST TARGET RNA, such as BINDING SITE I, BINDING SITE II and BINDING SITE III, inhibits translation of VGAM158 host target RNA, herein designated VGAM HOST TARGET RNA, into VGAM158 host target protein, herein designated VGAM HOST TARGET PROTEIN. VGAM host target protein is therefore outlined by a broken line.

It is appreciated that VGAM158 host target gene, herein designated VGAM HOST TARGET GENE, in fact represents a plurality of VGAM158 host target genes. The mRNA of each one of this plurality of VGAM158 host target genes comprises one or more host target binding sites, each having a nucleotide sequence which is at least partly complementary to VGAM158 RNA, herein designated VGAM RNA, and which when bound by VGAM158 RNA, herein designated VGAM RNA, causes inhibition of translation of respective one or more VGAM158 host target proteins.

It is further appreciated by one skilled in the art that the mode of translational inhibition illustrated by FIG. 1 with specific reference to translational inhibition exerted by VGAM158 gene, herein designated VGAM GENE, on one or more VGAM158 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM158 is inhibition of expression of host target genes, as part of a novel viral mechanism of attacking a host. Accordingly, utilities of VGAM158 include diagnosis, prevention and treatment of viral infection by Vaccinia virus. Specific functions, and accordingly utilities, of VGAM158 correlate with, and may be deduced from, the identity of the host target genes which VGAM158 binds and inhibits, and the function of these host target genes, as elaborated hereinbelow.

Nucleotide sequences of the VGAM158 precursor RNA, herein designated VGAM PRECURSOR RNA, and of the diced VGAM158 RNA, herein designated VGAM RNA, and a schematic representation of the secondary folding of VGAM158 folded precursor RNA, herein designated VGAM FOLDED PRECURSOR RNA, of VGAM158 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM158 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 159 (VGAM159) viral gene, which modulates expression of respective host target genes thereof, the function and utility of which host target genes is known in the art.

VGAM159 is a novel bioinformatically detected regulatory, non protein coding, viral micro RNA (miRNA) gene. The method by which VGAM159 was detected is described hereinabove with reference to FIGS. 2-8.

VGAM159 gene, herein designated VGAM GENE, is a viral gene contained in the genome of Vaccinia virus. VGAM159 host target gene, herein designated VGAM HOST TARGET GENE, is a human gene contained in the human genome.

VGAM159 gene, herein designated VGAM GENE, encodes a VGAM159 precursor RNA, herein designated VGAM PRECURSOR RNA. Similar to other miRNA genes, and unlike most ordinary genes, VGAM159 precursor RNA, herein designated VGAM PRECURSOR RNA, does not encode a protein. A nucleotide sequence identical or highly similar to the nucleotide sequence of VGAM159 precursor RNA is designated SEQ ID:145, and is provided hereinbelow with reference to the sequence listing part. Nucleotide sequence SEQ ID:145 is located at position 81761 relative to the genome of Vaccinia virus.

VGAM159 precursor RNA, herein designated VGAM PRECURSOR RNA, folds onto itself, forming VGAM159 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM159 folded precursor RNA, herein designated VGAM FOLDED PRECURSOR RNA, into VGAM159 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 85%) nucleotide sequence of VGAM159 RNA is designated SEQ ID:494, and is provided hereinbelow with reference to the sequence listing part.

VGAM159 host target gene, herein designated VGAM HOST TARGET GENE, encodes a corresponding messenger RNA, VGAM159 host target RNA, herein designated VGAM HOST TARGET RNA. VGAM159 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM159 RNA, herein designated VGAM RNA, binds complementarily to one or more host target binding sites located in untranslated regions of VGAM159 host target RNA, herein designated VGAM HOST TARGET RNA. This complementary binding is due to the fact that the nucleotide sequence of VGAM159 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM159 RNA, herein designated VGAM RNA, may have a different number of host target binding sites in untranslated regions of a VGAM159 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM159 RNA, herein designated VGAM RNA, to host target binding sites on VGAM159 host target RNA, herein designated VGAM HOST TARGET RNA, such as BINDING SITE I, BINDING SITE II and BINDING SITE III, inhibits translation of VGAM159 host target RNA, herein designated VGAM HOST TARGET RNA, into VGAM159 host target protein, herein designated VGAM HOST TARGET PROTEIN. VGAM host target protein is therefore outlined by a broken line.

It is appreciated that VGAM159 host target gene, herein designated VGAM HOST TARGET GENE, in fact represents a plurality of VGAM159 host target genes. The mRNA of each one of this plurality of VGAM159 host target genes comprises one or more host target binding sites, each having a nucleotide sequence which is at least partly complementary to VGAM159 RNA, herein designated VGAM RNA, and which when bound by VGAM159 RNA, herein designated VGAM RNA, causes inhibition of translation of respective one or more VGAM159 host target proteins.

It is further appreciated by one skilled in the art that the mode of translational inhibition illustrated by FIG. 1 with specific reference to translational inhibition exerted by VGAM159 gene, herein designated VGAM GENE, on one or more VGAM159 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM159 is inhibition of expression of host target genes, as part of a novel viral mechanism of attacking a host. Accordingly, utilities of VGAM159 include diagnosis, prevention and treatment of viral infection by Vaccinia virus. Specific functions, and accordingly utilities, of VGAM159 correlate with, and may be deduced from, the identity of the host target genes which VGAM159 binds and inhibits, and the function of these host target genes, as elaborated hereinbelow.

Nucleotide sequences of the VGAM159 precursor RNA, herein designated VGAM PRECURSOR RNA, and of the diced VGAM159 RNA, herein designated VGAM RNA, and a schematic representation of the secondary folding of VGAM159 folded precursor RNA, herein designated VGAM FOLDED PRECURSOR RNA, of VGAM159 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM159 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 160 (VGAM160) viral gene, which modulates expression of respective host target genes thereof, the function and utility of which host target genes is known in the art.

VGAM160 is a novel bioinformatically detected regulatory, non protein coding, viral micro RNA (miRNA) gene. The method by which VGAM160 was detected is described hereinabove with reference to FIGS. 2-8.

VGAM160 gene, herein designated VGAM GENE, is a viral gene contained in the genome of Vaccinia virus. VGAM160 host target gene, herein designated VGAM HOST TARGET GENE, is a human gene contained in the human genome.

VGAM160 gene, herein designated VGAM GENE, encodes a VGAM160 precursor RNA, herein designated VGAM PRECURSOR RNA. Similar to other miRNA genes, and unlike most ordinary genes, VGAM160 precursor RNA, herein designated VGAM PRECURSOR RNA, does not encode a protein. A nucleotide sequence identical or highly similar to the nucleotide sequence of VGAM160 precursor RNA is designated SEQ ID:146, and is provided hereinbelow with reference to the sequence listing part. Nucleotide sequence SEQ ID:146 is located at position 81960 relative to the genome of Vaccinia virus.

VGAM160 precursor RNA, herein designated VGAM PRECURSOR RNA, folds onto itself, forming VGAM160 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM160 folded precursor RNA, herein designated VGAM FOLDED PRECURSOR RNA, into VGAM160 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 86%) nucleotide sequence of VGAM160 RNA is designated SEQ ID:495, and is provided hereinbelow with reference to the sequence listing part.

VGAM160 host target gene, herein designated VGAM HOST TARGET GENE, encodes a corresponding messenger RNA, VGAM160 host target RNA, herein designated VGAM HOST TARGET RNA. VGAM160 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM160 RNA, herein designated VGAM RNA, binds complementarily to one or more host target binding sites located in untranslated regions of VGAM160 host target RNA, herein designated VGAM HOST TARGET RNA. This complementary binding is due to the fact that the nucleotide sequence of VGAM160 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM160 RNA, herein designated VGAM RNA, may have a different number of host target binding sites in untranslated regions of a VGAM160 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM160 RNA, herein designated VGAM RNA, to host target binding sites on VGAM160 host target RNA, herein designated VGAM HOST TARGET RNA, such as BINDING SITE I, BINDING SITE II and BINDING SITE III, inhibits translation of VGAM160 host target RNA, herein designated VGAM HOST TARGET RNA, into VGAM160 host target protein, herein designated VGAM HOST TARGET PROTEIN. VGAM host target protein is therefore outlined by a broken line.

It is appreciated that VGAM160 host target gene, herein designated VGAM HOST TARGET GENE, in fact represents a plurality of VGAM160 host target genes. The mRNA of each one of this plurality of VGAM160 host target genes comprises one or more host target binding sites, each having a nucleotide sequence which is at least partly complementary to VGAM160 RNA, herein designated VGAM RNA, and which when bound by VGAM160 RNA, herein designated VGAM RNA, causes inhibition of translation of respective one or more VGAM160 host target proteins.

It is further appreciated by one skilled in the art that the mode of translational inhibition illustrated by FIG. 1 with specific reference to translational inhibition exerted by VGAM160 gene, herein designated VGAM GENE, on one or more VGAM160 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM160 is inhibition of expression of host target genes, as part of a novel viral mechanism of attacking a host. Accordingly, utilities of VGAM160 include diagnosis, prevention and treatment of viral infection by Vaccinia virus. Specific functions, and accordingly utilities, of VGAM160 correlate with, and may be deduced from, the identity of the host target genes which VGAM160 binds and inhibits, and the function of these host target genes, as elaborated hereinbelow.

Nucleotide sequences of the VGAM160 precursor RNA, herein designated VGAM PRECURSOR RNA, and of the diced VGAM160 RNA, herein designated VGAM RNA, and a schematic representation of the secondary folding of VGAM160 folded precursor RNA, herein designated VGAM FOLDED PRECURSOR RNA, of VGAM160 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM160 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 161 (VGAM161) viral gene, which modulates expression of respective host target genes thereof, the function and utility of which host target genes is known in the art.

VGAM161 is a novel bioinformatically detected regulatory, non protein coding, viral micro RNA (miRNA) gene. The method by which VGAM161 was detected is described hereinabove with reference to FIGS. 2-8.

VGAM161 gene, herein designated VGAM GENE, is a viral gene contained in the genome of Vaccinia virus. VGAM161 host target gene, herein designated VGAM HOST TARGET GENE, is a human gene contained in the human genome.

VGAM161 gene, herein designated VGAM GENE, encodes a VGAM161 precursor RNA, herein designated VGAM PRECURSOR RNA. Similar to other miRNA genes, and unlike most ordinary genes, VGAM161 precursor RNA, herein designated VGAM PRECURSOR RNA, does not encode a protein. A nucleotide sequence identical or highly similar to the nucleotide sequence of VGAM161 precursor RNA is designated SEQ ID:147, and is provided hereinbelow with reference to the sequence listing part. Nucleotide sequence SEQ ID:147 is located at position 81428 relative to the genome of Vaccinia virus.

VGAM161 precursor RNA, herein designated VGAM PRECURSOR RNA, folds onto itself, forming VGAM161 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM161 folded precursor RNA, herein designated VGAM FOLDED PRECURSOR RNA, into VGAM161 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 72%) nucleotide sequence of VGAM161 RNA is designated SEQ ID:496, and is provided hereinbelow with reference to the sequence listing part.

VGAM161 host target gene, herein designated VGAM HOST TARGET GENE, encodes a corresponding messenger RNA, VGAM161 host target RNA, herein designated VGAM HOST TARGET RNA. VGAM161 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM161 RNA, herein designated VGAM RNA, binds complementarily to one or more host target binding sites located in untranslated regions of VGAM161 host target RNA, herein designated VGAM HOST TARGET RNA. This complementary binding is due to the fact that the nucleotide sequence of VGAM161 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM161 RNA, herein designated VGAM RNA, may have a different number of host target binding sites in untranslated regions of a VGAM161 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM161 RNA, herein designated VGAM RNA, to host target binding sites on VGAM161 host target RNA, herein designated VGAM HOST TARGET RNA, such as BINDING SITE I, BINDING SITE II and BINDING SITE III, inhibits translation of VGAM161 host target RNA, herein designated VGAM HOST TARGET RNA, into VGAM161 host target protein, herein designated VGAM HOST TARGET PROTEIN. VGAM host target protein is therefore outlined by a broken line.

It is appreciated that VGAM161 host target gene, herein designated VGAM HOST TARGET GENE, in fact represents a plurality of VGAM161 host target genes. The mRNA of each one of this plurality of VGAM161 host target genes comprises one or more host target binding sites, each having a nucleotide sequence which is at least partly complementary to VGAM161 RNA, herein designated VGAM RNA, and which when bound by VGAM161 RNA, herein designated VGAM RNA, causes inhibition of translation of respective one or more VGAM161 host target proteins.

It is further appreciated by one skilled in the art that the mode of translational inhibition illustrated by FIG. 1 with specific reference to translational inhibition exerted by VGAM161 gene, herein designated VGAM GENE, on one or more VGAM161 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM161 is inhibition of expression of host target genes, as part of a novel viral mechanism of attacking a host. Accordingly, utilities of VGAM161 include diagnosis, prevention and treatment of viral infection by Vaccinia virus. Specific functions, and accordingly utilities, of VGAM161 correlate with, and may be deduced from, the identity of the host target genes which VGAM161 binds and inhibits, and the function of these host target genes, as elaborated hereinbelow.

Nucleotide sequences of the VGAM161 precursor RNA, herein designated VGAM PRECURSOR RNA, and of the diced VGAM161 RNA, herein designated VGAM RNA, and a schematic representation of the secondary folding of VGAM161 folded precursor RNA, herein designated VGAM FOLDED PRECURSOR RNA, of VGAM161 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM161 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 162 (VGAM162) viral gene, which modulates expression of respective host target genes thereof, the function and utility of which host target genes is known in the art.

VGAM162 is a novel bioinformatically detected regulatory, non protein coding, viral micro RNA (miRNA) gene. The method by which VGAM162 was detected is described hereinabove with reference to FIGS. 2-8.

VGAM162 gene, herein designated VGAM GENE, is a viral gene contained in the genome of Vaccinia virus. VGAM162 host target gene, herein designated VGAM HOST TARGET GENE, is a human gene contained in the human genome.

VGAM162 gene, herein designated VGAM GENE, encodes a VGAM162 precursor RNA, herein designated VGAM PRECURSOR RNA. Similar to other miRNA genes, and unlike most ordinary genes, VGAM162 precursor RNA, herein designated VGAM PRECURSOR RNA, does not encode a protein. A nucleotide sequence identical or highly similar to the nucleotide sequence of VGAM162 precursor RNA is designated SEQ ID:148, and is provided hereinbelow with reference to the sequence listing part. Nucleotide sequence SEQ ID:148 is located at position 81204 relative to the genome of Vaccinia virus.

VGAM162 precursor RNA, herein designated VGAM PRECURSOR RNA, folds onto itself, forming VGAM162 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM162 folded precursor RNA, herein designated VGAM FOLDED PRECURSOR RNA, into VGAM162 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 77%) nucleotide sequence of VGAM162 RNA is designated SEQ ID:497, and is provided hereinbelow with reference to the sequence listing part.

VGAM162 host target gene, herein designated VGAM HOST TARGET GENE, encodes a corresponding messenger RNA, VGAM162 host target RNA, herein designated VGAM HOST TARGET RNA. VGAM162 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM162 RNA, herein designated VGAM RNA, binds complementarily to one or more host target binding sites located in untranslated regions of VGAM162 host target RNA, herein designated VGAM HOST TARGET RNA. This complementary binding is due to the fact that the nucleotide sequence of VGAM162 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM162 RNA, herein designated VGAM RNA, may have a different number of host target binding sites in untranslated regions of a VGAM162 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM162 RNA, herein designated VGAM RNA, to host target binding sites on VGAM162 host target RNA, herein designated VGAM HOST TARGET RNA, such as BINDING SITE I, BINDING SITE II and BINDING SITE III, inhibits translation of VGAM162 host target RNA, herein designated VGAM HOST TARGET RNA, into VGAM162 host target protein, herein designated VGAM HOST TARGET PROTEIN. VGAM host target protein is therefore outlined by a broken line.

It is appreciated that VGAM162 host target gene, herein designated VGAM HOST TARGET GENE, in fact represents a plurality of VGAM162 host target genes. The mRNA of each one of this plurality of VGAM162 host target genes comprises one or more host target binding sites, each having a nucleotide sequence which is at least partly complementary to VGAM162 RNA, herein designated VGAM RNA, and which when bound by VGAM162 RNA, herein designated VGAM RNA, causes inhibition of translation of respective one or more VGAM162 host target proteins.

It is further appreciated by one skilled in the art that the mode of translational inhibition illustrated by FIG. 1 with specific reference to translational inhibition exerted by VGAM162 gene, herein designated VGAM GENE, on one or more VGAM162 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM162 is inhibition of expression of host target genes, as part of a novel viral mechanism of attacking a host. Accordingly, utilities of VGAM162 include diagnosis, prevention and treatment of viral infection by Vaccinia virus. Specific functions, and accordingly utilities, of VGAM162 correlate with, and may be deduced from, the identity of the host target genes which VGAM162 binds and inhibits, and the function of these host target genes, as elaborated hereinbelow.

Nucleotide sequences of the VGAM162 precursor RNA, herein designated VGAM PRECURSOR RNA, and of the diced VGAM162 RNA, herein designated VGAM RNA, and a schematic representation of the secondary folding of VGAM162 folded precursor RNA, herein designated VGAM FOLDED PRECURSOR RNA, of VGAM162 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM162 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 163 (VGAM163) viral gene, which modulates expression of respective host target genes thereof, the function and utility of which host target genes is known in the art.

VGAM163 is a novel bioinformatically detected regulatory, non protein coding, viral micro RNA (miRNA) gene. The method by which VGAM163 was detected is described hereinabove with reference to FIGS. 2-8.

VGAM163 gene, herein designated VGAM GENE, is a viral gene contained in the genome of Vaccinia virus. VGAM163 host target gene, herein designated VGAM HOST TARGET GENE, is a human gene contained in the human genome.

VGAM163 gene, herein designated VGAM GENE, encodes a VGAM163 precursor RNA, herein designated VGAM PRECURSOR RNA. Similar to other miRNA genes, and unlike most ordinary genes, VGAM163 precursor RNA, herein designated VGAM PRECURSOR RNA, does not encode a protein. A nucleotide sequence identical or highly similar to the nucleotide sequence of VGAM163 precursor RNA is designated SEQ ID:149, and is provided hereinbelow with reference to the sequence listing part. Nucleotide sequence SEQ ID: 149 is located at position 83968 relative to the genome of Vaccinia virus.

VGAM163 precursor RNA, herein designated VGAM PRECURSOR RNA, folds onto itself, forming VGAM163 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM163 folded precursor RNA, herein designated VGAM FOLDED PRECURSOR RNA, into VGAM163 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM163 RNA is designated SEQ ID:498, and is provided hereinbelow with reference to the sequence listing part.

VGAM163 host target gene, herein designated VGAM HOST TARGET GENE, encodes a corresponding messenger RNA, VGAM163 host target RNA, herein designated VGAM HOST TARGET RNA. VGAM163 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM163 RNA, herein designated VGAM RNA, binds complementarily to one or more host target binding sites located in untranslated regions of VGAM163 host target RNA, herein designated VGAM HOST TARGET RNA. This complementary binding is due to the fact that the nucleotide sequence of VGAM163 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM163 RNA, herein designated VGAM RNA, may have a different number of host target binding sites in untranslated regions of a VGAM163 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM163 RNA, herein designated VGAM RNA, to host target binding sites on VGAM163 host target RNA, herein designated VGAM HOST TARGET RNA, such as BINDING SITE I, BINDING SITE II and BINDING SITE III, inhibits translation of VGAM163 host target RNA, herein designated VGAM HOST TARGET RNA, into VGAM163 host target protein, herein designated VGAM HOST TARGET PROTEIN. VGAM host target protein is therefore outlined by a broken line.

It is appreciated that VGAM163 host target gene, herein designated VGAM HOST TARGET GENE, in fact represents a plurality of VGAM163 host target genes. The mRNA of each one of this plurality of VGAM163 host target genes comprises one or more host target binding sites, each having a nucleotide sequence which is at least partly complementary to VGAM163 RNA, herein designated VGAM RNA, and which when bound by VGAM163 RNA, herein designated VGAM RNA, causes inhibition of translation of respective one or more VGAM163 host target proteins.

It is further appreciated by one skilled in the art that the mode of translational inhibition illustrated by FIG. 1 with specific reference to translational inhibition exerted by VGAM163 gene, herein designated VGAM GENE, on one or more VGAM163 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM163 is inhibition of expression of host target genes, as part of a novel viral mechanism of attacking a host. Accordingly, utilities of VGAM163 include diagnosis, prevention and treatment of viral infection by Vaccinia virus. Specific functions, and accordingly utilities, of VGAM163 correlate with, and may be deduced from, the identity of the host target genes which VGAM163 binds and inhibits, and the function of these host target genes, as elaborated hereinbelow.

Nucleotide sequences of the VGAM163 precursor RNA, herein designated VGAM PRECURSOR RNA, and of the diced VGAM163 RNA, herein designated VGAM RNA, and a schematic representation of the secondary folding of VGAM163 folded precursor RNA, herein designated VGAM FOLDED PRECURSOR RNA, of VGAM163 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM163 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 164 (VGAM164) viral gene, which modulates expression of respective host target genes thereof, the function and utility of which host target genes is known in the art.

VGAM164 is a novel bioinformatically detected regulatory, non protein coding, viral micro RNA (miRNA) gene. The method by which VGAM164 was detected is described hereinabove with reference to FIGS. 2-8.

VGAM164 gene, herein designated VGAM GENE, is a viral gene contained in the genome of Vaccinia virus. VGAM164 host target gene, herein designated VGAM HOST TARGET GENE, is a human gene contained in the human genome.

VGAM164 gene, herein designated VGAM GENE, encodes a VGAM164 precursor RNA, herein designated VGAM PRECURSOR RNA. Similar to other miRNA genes, and unlike most ordinary genes, VGAM164 precursor RNA, herein designated VGAM PRECURSOR RNA, does not encode a protein. A nucleotide sequence identical or highly similar to the nucleotide sequence of VGAM164 precursor RNA is designated SEQ ID:150, and is provided hereinbelow with reference to the sequence listing part. Nucleotide sequence SEQ ID:150 is located at position 84375 relative to the genome of Vaccinia virus.

VGAM164 precursor RNA, herein designated VGAM PRECURSOR RNA, folds onto itself, forming VGAM164 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM164 folded precursor RNA, herein designated VGAM FOLDED PRECURSOR RNA, into VGAM164 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM164 RNA is designated SEQ ID:499, and is provided hereinbelow with reference to the sequence listing part.

VGAM164 host target gene, herein designated VGAM HOST TARGET GENE, encodes a corresponding messenger RNA, VGAM164 host target RNA, herein designated VGAM HOST TARGET RNA. VGAM164 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM164 RNA, herein designated VGAM RNA, binds complementarily to one or more host target binding sites located in untranslated regions of VGAM164 host target RNA, herein designated VGAM HOST TARGET RNA. This complementary binding is due to the fact that the nucleotide sequence of VGAM164 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM164 RNA, herein designated VGAM RNA, may have a different number of host target binding sites in untranslated regions of a VGAM164 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM164 RNA, herein designated VGAM RNA, to host target binding sites on VGAM164 host target RNA, herein designated VGAM HOST TARGET RNA, such as BINDING SITE I, BINDING SITE II and BINDING SITE III, inhibits translation of VGAM164 host target RNA, herein designated VGAM HOST TARGET RNA, into VGAM164 host target protein, herein designated VGAM HOST TARGET PROTEIN. VGAM host target protein is therefore outlined by a broken line.

It is appreciated that VGAM164 host target gene, herein designated VGAM HOST TARGET GENE, in fact represents a plurality of VGAM164 host target genes. The mRNA of each one of this plurality of VGAM164 host target genes comprises one or more host target binding sites, each having a nucleotide sequence which is at least partly complementary to VGAM164 RNA, herein designated VGAM RNA, and which when bound by VGAM164 RNA, herein designated VGAM RNA, causes inhibition of translation of respective one or more VGAM164 host target proteins.

It is further appreciated by one skilled in the art that the mode of translational inhibition illustrated by FIG. 1 with specific reference to translational inhibition exerted by VGAM164 gene, herein designated VGAM GENE, on one or more VGAM164 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM164 is inhibition of expression of host target genes, as part of a novel viral mechanism of attacking a host. Accordingly, utilities of VGAM164 include diagnosis, prevention and treatment of viral infection by Vaccinia virus. Specific functions, and accordingly utilities, of VGAM164 correlate with, and may be deduced from, the identity of the host target genes which VGAM164 binds and inhibits, and the function of these host target genes, as elaborated hereinbelow.

Nucleotide sequences of the VGAM164 precursor RNA, herein designated VGAM PRECURSOR RNA, and of the diced VGAM164 RNA, herein designated VGAM RNA, and a schematic representation of the secondary folding of VGAM164 folded precursor RNA, herein designated VGAM FOLDED PRECURSOR RNA, of VGAM164 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM164 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 165 (VGAM165) viral gene, which modulates expression of respective host target genes thereof, the function and utility of which host target genes is known in the art.

VGAM165 is a novel bioinformatically detected regulatory, non protein coding, viral micro RNA (miRNA) gene. The method by which VGAM165 was detected is described hereinabove with reference to FIGS. 2-8.

VGAM165 gene, herein designated VGAM GENE, is a viral gene contained in the genome of Vaccinia virus. VGAM165 host target gene, herein designated VGAM HOST TARGET GENE, is a human gene contained in the human genome.

VGAM165 gene, herein designated VGAM GENE, encodes a VGAM165 precursor RNA, herein designated VGAM PRECURSOR RNA. Similar to other miRNA genes, and unlike most ordinary genes, VGAM165 precursor RNA, herein designated VGAM PRECURSOR RNA, does not encode a protein. A nucleotide sequence identical or highly similar to the nucleotide sequence of VGAM165 precursor RNA is designated SEQ ID: 151, and is provided hereinbelow with reference to the sequence listing part. Nucleotide sequence SEQ ID:151 is located at position 84949 relative to the genome of Vaccinia virus.

VGAM165 precursor RNA, herein designated VGAM PRECURSOR RNA, folds onto itself, forming VGAM165 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM165 folded precursor RNA, herein designated VGAM FOLDED PRECURSOR RNA, into VGAM165 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM165 RNA is designated SEQ ID:500, and is provided hereinbelow with reference to the sequence listing part.

VGAM165 host target gene, herein designated VGAM HOST TARGET GENE, encodes a corresponding messenger RNA, VGAM165 host target RNA, herein designated VGAM HOST TARGET RNA. VGAM165 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM165 RNA, herein designated VGAM RNA, binds complementarily to one or more host target binding sites located in untranslated regions of VGAM165 host target RNA, herein designated VGAM HOST TARGET RNA. This complementary binding is due to the fact that the nucleotide sequence of VGAM165 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM165 RNA, herein designated VGAM RNA, may have a different number of host target binding sites in untranslated regions of a VGAM165 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM165 RNA, herein designated VGAM RNA, to host target binding sites on VGAM165 host target RNA, herein designated VGAM HOST TARGET RNA, such as BINDING SITE I, BINDING SITE II and BINDING SITE III, inhibits translation of VGAM165 host target RNA, herein designated VGAM HOST TARGET RNA, into VGAM165 host target protein, herein designated VGAM HOST TARGET PROTEIN. VGAM host target protein is therefore outlined by a broken line.

It is appreciated that VGAM165 host target gene, herein designated VGAM HOST TARGET GENE, in fact represents a plurality of VGAM165 host target genes. The mRNA of each one of this plurality of VGAM165 host target genes comprises one or more host target binding sites, each having a nucleotide sequence which is at least partly complementary to VGAM165 RNA, herein designated VGAM RNA, and which when bound by VGAM165 RNA, herein designated VGAM RNA, causes inhibition of translation of respective one or more VGAM165 host target proteins.

It is further appreciated by one skilled in the art that the mode of translational inhibition illustrated by FIG. 1 with specific reference to translational inhibition exerted by VGAM165 gene, herein designated VGAM GENE, on one or more VGAM165 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM165 is inhibition of expression of host target genes, as part of a novel viral mechanism of attacking a host. Accordingly, utilities of VGAM165 include diagnosis, prevention and treatment of viral infection by Vaccinia virus. Specific functions, and accordingly utilities, of VGAM165 correlate with, and may be deduced from, the identity of the host target genes which VGAM165 binds and inhibits, and the function of these host target genes, as elaborated hereinbelow.

Nucleotide sequences of the VGAM165 precursor RNA, herein designated VGAM PRECURSOR RNA, and of the diced VGAM165 RNA, herein designated VGAM RNA, and a schematic representation of the secondary folding of VGAM165 folded precursor RNA, herein designated VGAM FOLDED PRECURSOR RNA, of VGAM165 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM165 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 166 (VGAM166) viral gene, which modulates expression of respective host target genes thereof, the function and utility of which host target genes is known in the art.

VGAM166 is a novel bioinformatically detected regulatory, non protein coding, viral micro RNA (miRNA) gene. The method by which VGAM166 was detected is described hereinabove with reference to FIGS. 2-8.

VGAM166 gene, herein designated VGAM GENE, is a viral gene contained in the genome of Vaccinia virus. VGAM166 host target gene, herein designated VGAM HOST TARGET GENE, is a human gene contained in the human genome.

VGAM166 gene, herein designated VGAM GENE, encodes a VGAM166 precursor RNA, herein designated VGAM PRECURSOR RNA. Similar to other miRNA genes, and unlike most ordinary genes, VGAM166 precursor RNA, herein designated VGAM PRECURSOR RNA, does not encode a protein. A nucleotide sequence identical or highly similar to the nucleotide sequence of VGAM166 precursor RNA is designated SEQ ID:152, and is provided hereinbelow with reference to the sequence listing part. Nucleotide sequence SEQ ID:152 is located at position 83280 relative to the genome of Vaccinia virus.

VGAM166 precursor RNA, herein designated VGAM PRECURSOR RNA, folds onto itself, forming VGAM166 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM166 folded precursor RNA, herein designated VGAM FOLDED PRECURSOR RNA, into VGAM166 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 85%) nucleotide sequence of VGAM166 RNA is designated SEQ ID:501, and is provided hereinbelow with reference to the sequence listing part.

VGAM166 host target gene, herein designated VGAM HOST TARGET GENE, encodes a corresponding messenger RNA, VGAM166 host target RNA, herein designated VGAM HOST TARGET RNA. VGAM166 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM166 RNA, herein designated VGAM RNA, binds complementarily to one or more host target binding sites located in untranslated regions of VGAM166 host target RNA, herein designated VGAM HOST TARGET RNA. This complementary binding is due to the fact that the nucleotide sequence of VGAM166 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM166 RNA, herein designated VGAM RNA, may have a different number of host target binding sites in untranslated regions of a VGAM166 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM166 RNA, herein designated VGAM RNA, to host target binding sites on VGAM166 host target RNA, herein designated VGAM HOST TARGET RNA, such as BINDING SITE I, BINDING SITE II and BINDING SITE III, inhibits translation of VGAM166 host target RNA, herein designated VGAM HOST TARGET RNA, into VGAM166 host target protein, herein designated VGAM HOST TARGET PROTEIN. VGAM host target protein is therefore outlined by a broken line.

It is appreciated that VGAM166 host target gene, herein designated VGAM HOST TARGET GENE, in fact represents a plurality of VGAM166 host target genes. The mRNA of each one of this plurality of VGAM166 host target genes comprises one or more host target binding sites, each having a nucleotide sequence which is at least partly complementary to VGAM166 RNA, herein designated VGAM RNA, and which when bound by VGAM166 RNA, herein designated VGAM RNA, causes inhibition of translation of respective one or more VGAM166 host target proteins.

It is further appreciated by one skilled in the art that the mode of translational inhibition illustrated by FIG. 1 with specific reference to translational inhibition exerted by VGAM166 gene, herein designated VGAM GENE, on one or more VGAM166 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM166 is inhibition of expression of host target genes, as part of a novel viral mechanism of attacking a host. Accordingly, utilities of VGAM166 include diagnosis, prevention and treatment of viral infection by Vaccinia virus. Specific functions, and accordingly utilities, of VGAM166 correlate with, and may be deduced from, the identity of the host target genes which VGAM166 binds and inhibits, and the function of these host target genes, as elaborated hereinbelow.

Nucleotide sequences of the VGAM166 precursor RNA, herein designated VGAM PRECURSOR RNA, and of the diced VGAM166 RNA, herein designated VGAM RNA, and a schematic representation of the secondary folding of VGAM166 folded precursor RNA, herein designated VGAM FOLDED PRECURSOR RNA, of VGAM166 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM166 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 167 (VGAM167) viral gene, which modulates expression of respective host target genes thereof, the function and utility of which host target genes is known in the art.

VGAM167 is a novel bioinformatically detected regulatory, non protein coding, viral micro RNA (miRNA) gene. The method by which VGAM167 was detected is described hereinabove with reference to FIGS. 2-8.

VGAM167 gene, herein designated VGAM GENE, is a viral gene contained in the genome of Vaccinia virus. VGAM167 host target gene, herein designated VGAM HOST TARGET GENE, is a human gene contained in the human genome.

VGAM167 gene, herein designated VGAM GENE, encodes a VGAM167 precursor RNA, herein designated VGAM PRECURSOR RNA. Similar to other miRNA genes, and unlike most ordinary genes, VGAM167 precursor RNA, herein designated VGAM PRECURSOR RNA, does not encode a protein. A nucleotide sequence identical or highly similar to the nucleotide sequence of VGAM167 precursor RNA is designated SEQ ID:153, and is provided hereinbelow with reference to the sequence listing part. Nucleotide sequence SEQ ID:153 is located at position 85141 relative to the genome of Vaccinia virus.

VGAM167 precursor RNA, herein designated VGAM PRECURSOR RNA, folds onto itself, forming VGAM167 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM167 folded precursor RNA, herein designated VGAM FOLDED PRECURSOR RNA, into VGAM167 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM167 RNA is designated SEQ ID:502, and is provided hereinbelow with reference to the sequence listing part.

VGAM167 host target gene, herein designated VGAM HOST TARGET GENE, encodes a corresponding messenger RNA, VGAM167 host target RNA, herein designated VGAM HOST TARGET RNA. VGAM167 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM167 RNA, herein designated VGAM RNA, binds complementarily to one or more host target binding sites located in untranslated regions of VGAM167 host target RNA, herein designated VGAM HOST TARGET RNA. This complementary binding is due to the fact that the nucleotide sequence of VGAM167 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM167 RNA, herein designated VGAM RNA, may have a different number of host target binding sites in untranslated regions of a VGAM167 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM167 RNA, herein designated VGAM RNA, to host target binding sites on VGAM167 host target RNA, herein designated VGAM HOST TARGET RNA, such as BINDING SITE I, BINDING SITE II and BINDING SITE III, inhibits translation of VGAM167 host target RNA, herein designated VGAM HOST TARGET RNA, into VGAM167 host target protein, herein designated VGAM HOST TARGET PROTEIN. VGAM host target protein is therefore outlined by a broken line.

It is appreciated that VGAM167 host target gene, herein designated VGAM HOST TARGET GENE, in fact represents a plurality of VGAM167 host target genes. The mRNA of each one of this plurality of VGAM167 host target genes comprises one or more host target binding sites, each having a nucleotide sequence which is at least partly complementary to VGAM167 RNA, herein designated VGAM RNA, and which when bound by VGAM167 RNA, herein designated VGAM RNA, causes inhibition of translation of respective one or more VGAM167 host target proteins.

It is further appreciated by one skilled in the art that the mode of translational inhibition illustrated by FIG. 1 with specific reference to translational inhibition exerted by VGAM167 gene, herein designated VGAM GENE, on one or more VGAM167 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM167 is inhibition of expression of host target genes, as part of a novel viral mechanism of attacking a host. Accordingly, utilities of VGAM167 include diagnosis, prevention and treatment of viral infection by Vaccinia virus. Specific functions, and accordingly utilities, of VGAM167 correlate with, and may be deduced from, the identity of the host target genes which VGAM167 binds and inhibits, and the function of these host target genes, as elaborated hereinbelow.

Nucleotide sequences of the VGAM167 precursor RNA, herein designated VGAM PRECURSOR RNA, and of the diced VGAM167 RNA, herein designated VGAM RNA, and a schematic representation of the secondary folding of VGAM167 folded precursor RNA, herein designated VGAM FOLDED PRECURSOR RNA, of VGAM167 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM167 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 168 (VGAM168) viral gene, which modulates expression of respective host target genes thereof, the function and utility of which host target genes is known in the art.

VGAM168 is a novel bioinformatically detected regulatory, non protein coding, viral micro RNA (miRNA) gene. The method by which VGAM168 was detected is described hereinabove with reference to FIGS. 2-8.

VGAM168 gene, herein designated VGAM GENE, is a viral gene contained in the genome of Vaccinia virus. VGAM168 host target gene, herein designated VGAM HOST TARGET GENE, is a human gene contained in the human genome.

VGAM168 gene, herein designated VGAM GENE, encodes a VGAM168 precursor RNA, herein designated VGAM PRECURSOR RNA. Similar to other miRNA genes, and unlike most ordinary genes, VGAM168 precursor RNA, herein designated VGAM PRECURSOR RNA, does not encode a protein. A nucleotide sequence identical or highly similar to the nucleotide sequence of VGAM168 precursor RNA is designated SEQ ID:154, and is provided hereinbelow with reference to the sequence listing part. Nucleotide sequence SEQ ID:154 is located at position 83136 relative to the genome of Vaccinia virus.

VGAM168 precursor RNA, herein designated VGAM PRECURSOR RNA, folds onto itself, forming VGAM168 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM168 folded precursor RNA, herein designated VGAM FOLDED PRECURSOR RNA, into VGAM168 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 70%) nucleotide sequence of VGAM168 RNA is designated SEQ ID:503, and is provided hereinbelow with reference to the sequence listing part.

VGAM168 host target gene, herein designated VGAM HOST TARGET GENE, encodes a corresponding messenger RNA, VGAM168 host target RNA, herein designated VGAM HOST TARGET RNA. VGAM168 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM168 RNA, herein designated VGAM RNA, binds complementarily to one or more host target binding sites located in untranslated regions of VGAM168 host target RNA, herein designated VGAM HOST TARGET RNA. This complementary binding is due to the fact that the nucleotide sequence of VGAM168 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM168 RNA, herein designated VGAM RNA, may have a different number of host target binding sites in untranslated regions of a VGAM168 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM168 RNA, herein designated VGAM RNA, to host target binding sites on VGAM168 host target RNA, herein designated VGAM HOST TARGET RNA, such as BINDING SITE I, BINDING SITE II and BINDING SITE III, inhibits translation of VGAM168 host target RNA, herein designated VGAM HOST TARGET RNA, into VGAM168 host target protein, herein designated VGAM HOST TARGET PROTEIN. VGAM host target protein is therefore outlined by a broken line.

It is appreciated that VGAM168 host target gene, herein designated VGAM HOST TARGET GENE, in fact represents a plurality of VGAM168 host target genes. The mRNA of each one of this plurality of VGAM168 host target genes comprises one or more host target binding sites, each having a nucleotide sequence which is at least partly complementary to VGAM168 RNA, herein designated VGAM RNA, and which when bound by VGAM168 RNA, herein designated VGAM RNA, causes inhibition of translation of respective one or more VGAM168 host target proteins.

It is further appreciated by one skilled in the art that the mode of translational inhibition illustrated by FIG. 1 with specific reference to translational inhibition exerted by VGAM168 gene, herein designated VGAM GENE, on one or more VGAM168 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM168 is inhibition of expression of host target genes, as part of a novel viral mechanism of attacking a host. Accordingly, utilities of VGAM168 include diagnosis, prevention and treatment of viral infection by Vaccinia virus. Specific functions, and accordingly utilities, of VGAM168 correlate with, and may be deduced from, the identity of the host target genes which VGAM168 binds and inhibits, and the function of these host target genes, as elaborated hereinbelow.

Nucleotide sequences of the VGAM168 precursor RNA, herein designated VGAM PRECURSOR RNA, and of the diced VGAM168 RNA, herein designated VGAM RNA, and a schematic representation of the secondary folding of VGAM168 folded precursor RNA, herein designated VGAM FOLDED PRECURSOR RNA, of VGAM168 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM168 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 169 (VGAM169) viral gene, which modulates expression of respective host target genes thereof, the function and utility of which host target genes is known in the art.

VGAM169 is a novel bioinformatically detected regulatory, non protein coding, viral micro RNA (miRNA) gene. The method by which VGAM169 was detected is described hereinabove with reference to FIGS. 2-8.

VGAM169 gene, herein designated VGAM GENE, is a viral gene contained in the genome of Vaccinia virus. VGAM169 host target gene, herein designated VGAM HOST TARGET GENE, is a human gene contained in the human genome.

VGAM169 gene, herein designated VGAM GENE, encodes a VGAM169 precursor RNA, herein designated VGAM PRECURSOR RNA. Similar to other miRNA genes, and unlike most ordinary genes, VGAM169 precursor RNA, herein designated VGAM PRECURSOR RNA, does not encode a protein. A nucleotide sequence identical or highly similar to the nucleotide sequence of VGAM169 precursor RNA is designated SEQ ID:155, and is provided hereinbelow with reference to the sequence listing part. Nucleotide sequence SEQ ID:155 is located at position 87488 relative to the genome of Vaccinia virus.

VGAM169 precursor RNA, herein designated VGAM PRECURSOR RNA, folds onto itself, forming VGAM169 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM169 folded precursor RNA, herein designated VGAM FOLDED PRECURSOR RNA, into VGAM169 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 87%) nucleotide sequence of VGAM169 RNA is designated SEQ ID:504, and is provided hereinbelow with reference to the sequence listing part.

VGAM169 host target gene, herein designated VGAM HOST TARGET GENE, encodes a corresponding messenger RNA, VGAM169 host target RNA, herein designated VGAM HOST TARGET RNA. VGAM169 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM169 RNA, herein designated VGAM RNA, binds complementarily to one or more host target binding sites located in untranslated regions of VGAM169 host target RNA, herein designated VGAM HOST TARGET RNA. This complementary binding is due to the fact that the nucleotide sequence of VGAM169 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM169 RNA, herein designated VGAM RNA, may have a different number of host target binding sites in untranslated regions of a VGAM169 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM169 RNA, herein designated VGAM RNA, to host target binding sites on VGAM169 host target RNA, herein designated VGAM HOST TARGET RNA, such as BINDING SITE I, BINDING SITE II and BINDING SITE III, inhibits translation of VGAM169 host target RNA, herein designated VGAM HOST TARGET RNA, into VGAM169 host target protein, herein designated VGAM HOST TARGET PROTEIN. VGAM host target protein is therefore outlined by a broken line.

It is appreciated that VGAM169 host target gene, herein designated VGAM HOST TARGET GENE, in fact represents a plurality of VGAM169 host target genes. The mRNA of each one of this plurality of VGAM169 host target genes comprises one or more host target binding sites, each having a nucleotide sequence which is at least partly complementary to VGAM169 RNA, herein designated VGAM RNA, and which when bound by VGAM169 RNA, herein designated VGAM RNA, causes inhibition of translation of respective one or more VGAM169 host target proteins.

It is further appreciated by one skilled in the art that the mode of translational inhibition illustrated by FIG. 1 with specific reference to translational inhibition exerted by VGAM169 gene, herein designated VGAM GENE, on one or more VGAM169 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM169 is inhibition of expression of host target genes, as part of a novel viral mechanism of attacking a host. Accordingly, utilities of VGAM169 include diagnosis, prevention and treatment of viral infection by Vaccinia virus. Specific functions, and accordingly utilities, of VGAM169 correlate with, and may be deduced from, the identity of the host target genes which VGAM169 binds and inhibits, and the function of these host target genes, as elaborated hereinbelow.

Nucleotide sequences of the VGAM169 precursor RNA, herein designated VGAM PRECURSOR RNA, and of the diced VGAM169 RNA, herein designated VGAM RNA, and a schematic representation of the secondary folding of VGAM169 folded precursor RNA, herein designated VGAM FOLDED PRECURSOR RNA, of VGAM169 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM169 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 170 (VGAM170) viral gene, which modulates expression of respective host target genes thereof, the function and utility of which host target genes is known in the art.

VGAM170 is a novel bioinformatically detected regulatory, non protein coding, viral micro RNA (miRNA) gene. The method by which VGAM170 was detected is described hereinabove with reference to FIGS. 2-8.

VGAM170 gene, herein designated VGAM GENE, is a viral gene contained in the genome of Vaccinia virus. VGAM170 host target gene, herein designated VGAM HOST TARGET GENE, is a human gene contained in the human genome.

VGAM170 gene, herein designated VGAM GENE, encodes a VGAM170 precursor RNA, herein designated VGAM PRECURSOR RNA. Similar to other miRNA genes, and unlike most ordinary genes, VGAM170 precursor RNA, herein designated VGAM PRECURSOR RNA, does not encode a protein. A nucleotide sequence identical or highly similar to the nucleotide sequence of VGAM170 precursor RNA is designated SEQ ID:156, and is provided hereinbelow with reference to the sequence listing part. Nucleotide sequence SEQ ID:156 is located at position 88940 relative to the genome of Vaccinia virus.

VGAM170 precursor RNA, herein designated VGAM PRECURSOR RNA, folds onto itself, forming VGAM170 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM170 folded precursor RNA, herein designated VGAM FOLDED PRECURSOR RNA, into VGAM170 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 79%) nucleotide sequence of VGAM170 RNA is designated SEQ ID:505, and is provided hereinbelow with reference to the sequence listing part.

VGAM170 host target gene, herein designated VGAM HOST TARGET GENE, encodes a corresponding messenger RNA, VGAM170 host target RNA, herein designated VGAM HOST TARGET RNA. VGAM170 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM170 RNA, herein designated VGAM RNA, binds complementarily to one or more host target binding sites located in untranslated regions of VGAM170 host target RNA, herein designated VGAM HOST TARGET RNA. This complementary binding is due to the fact that the nucleotide sequence of VGAM170 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM170 RNA, herein designated VGAM RNA, may have a different number of host target binding sites in untranslated regions of a VGAM170 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM170 RNA, herein designated VGAM RNA, to host target binding sites on VGAM170 host target RNA, herein designated VGAM HOST TARGET RNA, such as BINDING SITE I, BINDING SITE II and BINDING SITE III, inhibits translation of VGAM170 host target RNA, herein designated VGAM HOST TARGET RNA, into VGAM170 host target protein, herein designated VGAM HOST TARGET PROTEIN. VGAM host target protein is therefore outlined by a broken line.

It is appreciated that VGAM170 host target gene, herein designated VGAM HOST TARGET GENE, in fact represents a plurality of VGAM170 host target genes. The mRNA of each one of this plurality of VGAM170 host target genes comprises one or more host target binding sites, each having a nucleotide sequence which is at least partly complementary to VGAM170 RNA, herein designated VGAM RNA, and which when bound by VGAM170 RNA, herein designated VGAM RNA, causes inhibition of translation of respective one or more VGAM170 host target proteins.

It is further appreciated by one skilled in the art that the mode of translational inhibition illustrated by FIG. 1 with specific reference to translational inhibition exerted by VGAM170 gene, herein designated VGAM GENE, on one or more VGAM170 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM170 is inhibition of expression of host target genes, as part of a novel viral mechanism of attacking a host. Accordingly, utilities of VGAM170 include diagnosis, prevention and treatment of viral infection by Vaccinia virus. Specific functions, and accordingly utilities, of VGAM170 correlate with, and may be deduced from, the identity of the host target genes which VGAM170 binds and inhibits, and the function of these host target genes, as elaborated hereinbelow.

Nucleotide sequences of the VGAM170 precursor RNA, herein designated VGAM PRECURSOR RNA, and of the diced VGAM170 RNA, herein designated VGAM RNA, and a schematic representation of the secondary folding of VGAM170 folded precursor RNA, herein designated VGAM FOLDED PRECURSOR RNA, of VGAM170 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM170 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 171 (VGAM171) viral gene, which modulates expression of respective host target genes thereof, the function and utility of which host target genes is known in the art.

VGAM171 is a novel bioinformatically detected regulatory, non protein coding, viral micro RNA (miRNA) gene. The method by which VGAM171 was detected is described hereinabove with reference to FIGS. 2-8.

VGAM171 gene, herein designated VGAM GENE, is a viral gene contained in the genome of Vaccinia virus. VGAM171 host target gene, herein designated VGAM HOST TARGET GENE, is a human gene contained in the human genome.

VGAM171 gene, herein designated VGAM GENE, encodes a VGAM171 precursor RNA, herein designated VGAM PRECURSOR RNA. Similar to other miRNA genes, and unlike most ordinary genes, VGAM171 precursor RNA, herein designated VGAM PRECURSOR RNA, does not encode a protein. A nucleotide sequence identical or highly similar to the nucleotide sequence of VGAM171 precursor RNA is designated SEQ ID: 157, and is provided hereinbelow with reference to the sequence listing part. Nucleotide sequence SEQ ID:157 is located at position 90530 relative to the genome of Vaccinia virus.

VGAM171 precursor RNA, herein designated VGAM PRECURSOR RNA, folds onto itself, forming VGAM171 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM171 folded precursor RNA, herein designated VGAM FOLDED PRECURSOR RNA, into VGAM171 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM171 RNA is designated SEQ ID:506, and is provided hereinbelow with reference to the sequence listing part.

VGAM171 host target gene, herein designated VGAM HOST TARGET GENE, encodes a corresponding messenger RNA, VGAM171 host target RNA, herein designated VGAM HOST TARGET RNA. VGAM171 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM171 RNA, herein designated VGAM RNA, binds complementarily to one or more host target binding sites located in untranslated regions of VGAM171 host target RNA, herein designated VGAM HOST TARGET RNA. This complementary binding is due to the fact that the nucleotide sequence of VGAM171 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM171 RNA, herein designated VGAM RNA, may have a different number of host target binding sites in untranslated regions of a VGAM171 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM171 RNA, herein designated VGAM RNA, to host target binding sites on VGAM171 host target RNA, herein designated VGAM HOST TARGET RNA, such as BINDING SITE I, BINDING SITE II and BINDING SITE III, inhibits translation of VGAM171 host target RNA, herein designated VGAM HOST TARGET RNA, into VGAM171 host target protein, herein designated VGAM HOST TARGET PROTEIN. VGAM host target protein is therefore outlined by a broken line.

It is appreciated that VGAM171 host target gene, herein designated VGAM HOST TARGET GENE, in fact represents a plurality of VGAM171 host target genes. The mRNA of each one of this plurality of VGAM171 host target genes comprises one or more host target binding sites, each having a nucleotide sequence which is at least partly complementary to VGAM171 RNA, herein designated VGAM RNA, and which when bound by VGAM171 RNA, herein designated VGAM RNA, causes inhibition of translation of respective one or more VGAM171 host target proteins.

It is further appreciated by one skilled in the art that the mode of translational inhibition illustrated by FIG. 1 with specific reference to translational inhibition exerted by VGAM171 gene, herein designated VGAM GENE, on one or more VGAM171 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM171 is inhibition of expression of host target genes, as part of a novel viral mechanism of attacking a host. Accordingly, utilities of VGAM171 include diagnosis, prevention and treatment of viral infection by Vaccinia virus. Specific functions, and accordingly utilities, of VGAM171 correlate with, and may be deduced from, the identity of the host target genes which VGAM171 binds and inhibits, and the function of these host target genes, as elaborated hereinbelow.

Nucleotide sequences of the VGAM171 precursor RNA, herein designated VGAM PRECURSOR RNA, and of the diced VGAM171 RNA, herein designated VGAM RNA, and a schematic representation of the secondary folding of VGAM171 folded precursor RNA, herein designated VGAM FOLDED PRECURSOR RNA, of VGAM171 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM171 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 172 (VGAM172) viral gene, which modulates expression of respective host target genes thereof, the function and utility of which host target genes is known in the art.

VGAM172 is a novel bioinformatically detected regulatory, non protein coding, viral micro RNA (miRNA) gene. The method by which VGAM172 was detected is described hereinabove with reference to FIGS. 2-8.

VGAM172 gene, herein designated VGAM GENE, is a viral gene contained in the genome of Vaccinia virus. VGAM172 host target gene, herein designated VGAM HOST TARGET GENE, is a human gene contained in the human genome.

VGAM172 gene, herein designated VGAM GENE, encodes a VGAM172 precursor RNA, herein designated VGAM PRECURSOR RNA. Similar to other miRNA genes, and unlike most ordinary genes, VGAM172 precursor RNA, herein designated VGAM PRECURSOR RNA, does not encode a protein. A nucleotide sequence identical or highly similar to the nucleotide sequence of VGAM172 precursor RNA is designated SEQ ID:158, and is provided hereinbelow with reference to the sequence listing part. Nucleotide sequence SEQ ID:158 is located at position 90682 relative to the genome of Vaccinia virus.

VGAM172 precursor RNA, herein designated VGAM PRECURSOR RNA, folds onto itself, forming VGAM172 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM172 folded precursor RNA, herein designated VGAM FOLDED PRECURSOR RNA, into VGAM172 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 76%) nucleotide sequence of VGAM172 RNA is designated SEQ ID:507, and is provided hereinbelow with reference to the sequence listing part.

VGAM172 host target gene, herein designated VGAM HOST TARGET GENE, encodes a corresponding messenger RNA, VGAM172 host target RNA, herein designated VGAM HOST TARGET RNA. VGAM172 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM172 RNA, herein designated VGAM RNA, binds complementarily to one or more host target binding sites located in untranslated regions of VGAM172 host target RNA, herein designated VGAM HOST TARGET RNA. This complementary binding is due to the fact that the nucleotide sequence of VGAM172 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM172 RNA, herein designated VGAM RNA, may have a different number of host target binding sites in untranslated regions of a VGAM172 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM172 RNA, herein designated VGAM RNA, to host target binding sites on VGAM172 host target RNA, herein designated VGAM HOST TARGET RNA, such as BINDING SITE I, BINDING SITE II and BINDING SITE III, inhibits translation of VGAM172 host target RNA, herein designated VGAM HOST TARGET RNA, into VGAM172 host target protein, herein designated VGAM HOST TARGET PROTEIN. VGAM host target protein is therefore outlined by a broken line.

It is appreciated that VGAM172 host target gene, herein designated VGAM HOST TARGET GENE, in fact represents a plurality of VGAM172 host target genes. The mRNA of each one of this plurality of VGAM172 host target genes comprises one or more host target binding sites, each having a nucleotide sequence which is at least partly complementary to VGAM172 RNA, herein designated VGAM RNA, and which when bound by VGAM172 RNA, herein designated VGAM RNA, causes inhibition of translation of respective one or more VGAM172 host target proteins.

It is further appreciated by one skilled in the art that the mode of translational inhibition illustrated by FIG. 1 with specific reference to translational inhibition exerted by VGAM172 gene, herein designated VGAM GENE, on one or more VGAM172 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM172 is inhibition of expression of host target genes, as part of a novel viral mechanism of attacking a host. Accordingly, utilities of VGAM172 include diagnosis, prevention and treatment of viral infection by Vaccinia virus. Specific functions, and accordingly utilities, of VGAM172 correlate with, and may be deduced from, the identity of the host target genes which VGAM172 binds and inhibits, and the function of these host target genes, as elaborated hereinbelow.

Nucleotide sequences of the VGAM172 precursor RNA, herein designated VGAM PRECURSOR RNA, and of the diced VGAM172 RNA, herein designated VGAM RNA, and a schematic representation of the secondary folding of VGAM172 folded precursor RNA, herein designated VGAM FOLDED PRECURSOR RNA, of VGAM172 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM172 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 173 (VGAM173) viral gene, which modulates expression of respective host target genes thereof, the function and utility of which host target genes is known in the art.

VGAM173 is a novel bioinformatically detected regulatory, non protein coding, viral micro RNA (miRNA) gene. The method by which VGAM173 was detected is described hereinabove with reference to FIGS. 2-8.

VGAM173 gene, herein designated VGAM GENE, is a viral gene contained in the genome of Vaccinia virus. VGAM173 host target gene, herein designated VGAM HOST TARGET GENE, is a human gene contained in the human genome.

VGAM173 gene, herein designated VGAM GENE, encodes a VGAM173 precursor RNA, herein designated VGAM PRECURSOR RNA. Similar to other miRNA genes, and unlike most ordinary genes, VGAM173 precursor RNA, herein designated VGAM PRECURSOR RNA, does not encode a protein. A nucleotide sequence identical or highly similar to the nucleotide sequence of VGAM173 precursor RNA is designated SEQ ID:159, and is provided hereinbelow with reference to the sequence listing part. Nucleotide sequence SEQ ID:159 is located at position 90131 relative to the genome of Vaccinia virus.

VGAM173 precursor RNA, herein designated VGAM PRECURSOR RNA, folds onto itself, forming VGAM173 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM173 folded precursor RNA, herein designated VGAM FOLDED PRECURSOR RNA, into VGAM173 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM173 RNA is designated SEQ ID:508, and is provided hereinbelow with reference to the sequence listing part.

VGAM173 host target gene, herein designated VGAM HOST TARGET GENE, encodes a corresponding messenger RNA, VGAM173 host target RNA, herein designated VGAM HOST TARGET RNA. VGAM173 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM173 RNA, herein designated VGAM RNA, binds complementarily to one or more host target binding sites located in untranslated regions of VGAM173 host target RNA, herein designated VGAM HOST TARGET RNA. This complementary binding is due to the fact that the nucleotide sequence of VGAM173 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM173 RNA, herein designated VGAM RNA, may have a different number of host target binding sites in untranslated regions of a VGAM173 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM173 RNA, herein designated VGAM RNA, to host target binding sites on VGAM173 host target RNA, herein designated VGAM HOST TARGET RNA, such as BINDING SITE I, BINDING SITE II and BINDING SITE III, inhibits translation of VGAM173 host target RNA, herein designated VGAM HOST TARGET RNA, into VGAM173 host target protein, herein designated VGAM HOST TARGET PROTEIN. VGAM host target protein is therefore outlined by a broken line.

It is appreciated that VGAM173 host target gene, herein designated VGAM HOST TARGET GENE, in fact represents a plurality of VGAM173 host target genes. The mRNA of each one of this plurality of VGAM173 host target genes comprises one or more host target binding sites, each having a nucleotide sequence which is at least partly complementary to VGAM173 RNA, herein designated VGAM RNA, and which when bound by VGAM173 RNA, herein designated VGAM RNA, causes inhibition of translation of respective one or more VGAM173 host target proteins.

It is further appreciated by one skilled in the art that the mode of translational inhibition illustrated by FIG. 1 with specific reference to translational inhibition exerted by VGAM173 gene, herein designated VGAM GENE, on one or more VGAM173 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM173 is inhibition of expression of host target genes, as part of a novel viral mechanism of attacking a host. Accordingly, utilities of VGAM173 include diagnosis, prevention and treatment of viral infection by Vaccinia virus. Specific functions, and accordingly utilities, of VGAM173 correlate with, and may be deduced from, the identity of the host target genes which VGAM173 binds and inhibits, and the function of these host target genes, as elaborated hereinbelow.

Nucleotide sequences of the VGAM173 precursor RNA, herein designated VGAM PRECURSOR RNA, and of the diced VGAM173 RNA, herein designated VGAM RNA, and a schematic representation of the secondary folding of VGAM173 folded precursor RNA, herein designated VGAM FOLDED PRECURSOR RNA, of VGAM173 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM173 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 174 (VGAM174) viral gene, which modulates expression of respective host target genes thereof, the function and utility of which host target genes is known in the art.

VGAM174 is a novel bioinformatically detected regulatory, non protein coding, viral micro RNA (miRNA) gene. The method by which VGAM174 was detected is described hereinabove with reference to FIGS. 2-8.

VGAM174 gene, herein designated VGAM GENE, is a viral gene contained in the genome of Vaccinia virus. VGAM174 host target gene, herein designated VGAM HOST TARGET GENE, is a human gene contained in the human genome.

VGAM174 gene, herein designated VGAM GENE, encodes a VGAM174 precursor RNA, herein designated VGAM PRECURSOR RNA. Similar to other miRNA genes, and unlike most ordinary genes, VGAM174 precursor RNA, herein designated VGAM PRECURSOR RNA, does not encode a protein. A nucleotide sequence identical or highly similar to the nucleotide sequence of VGAM174 precursor RNA is designated SEQ ID:160, and is provided hereinbelow with reference to the sequence listing part. Nucleotide sequence SEQ ID: 160 is located at position 89784 relative to the genome of Vaccinia virus.

VGAM174 precursor RNA, herein designated VGAM PRECURSOR RNA, folds onto itself, forming VGAM174 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM174 folded precursor RNA, herein designated VGAM FOLDED PRECURSOR RNA, into VGAM174 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 78%) nucleotide sequence of VGAM174 RNA is designated SEQ ID:509, and is provided hereinbelow with reference to the sequence listing part.

VGAM174 host target gene, herein designated VGAM HOST TARGET GENE, encodes a corresponding messenger RNA, VGAM174 host target RNA, herein designated VGAM HOST TARGET RNA. VGAM174 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM174 RNA, herein designated VGAM RNA, binds complementarily to one or more host target binding sites located in untranslated regions of VGAM174 host target RNA, herein designated VGAM HOST TARGET RNA. This complementary binding is due to the fact that the nucleotide sequence of VGAM174 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM174 RNA, herein designated VGAM RNA, may have a different number of host target binding sites in untranslated regions of a VGAM174 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM174 RNA, herein designated VGAM RNA, to host target binding sites on VGAM174 host target RNA, herein designated VGAM HOST TARGET RNA, such as BINDING SITE I, BINDING SITE II and BINDING SITE III, inhibits translation of VGAM174 host target RNA, herein designated VGAM HOST TARGET RNA, into VGAM174 host target protein, herein designated VGAM HOST TARGET PROTEIN. VGAM host target protein is therefore outlined by a broken line.

It is appreciated that VGAM174 host target gene, herein designated VGAM HOST TARGET GENE, in fact represents a plurality of VGAM174 host target genes. The mRNA of each one of this plurality of VGAM174 host target genes comprises one or more host target binding sites, each having a nucleotide sequence which is at least partly complementary to VGAM174 RNA, herein designated VGAM RNA, and which when bound by VGAM174 RNA, herein designated VGAM RNA, causes inhibition of translation of respective one or more VGAM174 host target proteins.

It is further appreciated by one skilled in the art that the mode of translational inhibition illustrated by FIG. 1 with specific reference to translational inhibition exerted by VGAM174 gene, herein designated VGAM GENE, on one or more VGAM174 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM174 is inhibition of expression of host target genes, as part of a novel viral mechanism of attacking a host. Accordingly, utilities of VGAM174 include diagnosis, prevention and treatment of viral infection by Vaccinia virus. Specific functions, and accordingly utilities, of VGAM174 correlate with, and may be deduced from, the identity of the host target genes which VGAM174 binds and inhibits, and the function of these host target genes, as elaborated hereinbelow.

Nucleotide sequences of the VGAM174 precursor RNA, herein designated VGAM PRECURSOR RNA, and of the diced VGAM174 RNA, herein designated VGAM RNA, and a schematic representation of the secondary folding of VGAM174 folded precursor RNA, herein designated VGAM FOLDED PRECURSOR RNA, of VGAM174 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM174 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 175 (VGAM175) viral gene, which modulates expression of respective host target genes thereof, the function and utility of which host target genes is known in the art.

VGAM175 is a novel bioinformatically detected regulatory, non protein coding, viral micro RNA (miRNA) gene. The method by which VGAM175 was detected is described hereinabove with reference to FIGS. 2-8.

VGAM175 gene, herein designated VGAM GENE, is a viral gene contained in the genome of Vaccinia virus. VGAM175 host target gene, herein designated VGAM HOST TARGET GENE, is a human gene contained in the human genome.

VGAM175 gene, herein designated VGAM GENE, encodes a VGAM175 precursor RNA, herein designated VGAM PRECURSOR RNA. Similar to other miRNA genes, and unlike most ordinary genes, VGAM175 precursor RNA, herein designated VGAM PRECURSOR RNA, does not encode a protein. A nucleotide sequence identical or highly similar to the nucleotide sequence of VGAM175 precursor RNA is designated SEQ ID:161, and is provided hereinbelow with reference to the sequence listing part. Nucleotide sequence SEQ ID:161 is located at position 91213 relative to the genome of Vaccinia virus.

VGAM175 precursor RNA, herein designated VGAM PRECURSOR RNA, folds onto itself, forming VGAM175 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM175 folded precursor RNA, herein designated VGAM FOLDED PRECURSOR RNA, into VGAM175 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 86%) nucleotide sequence of VGAM175 RNA is designated SEQ ID:510, and is provided hereinbelow with reference to the sequence listing part.

VGAM175 host target gene, herein designated VGAM HOST TARGET GENE, encodes a corresponding messenger RNA, VGAM175 host target RNA, herein designated VGAM HOST TARGET RNA. VGAM175 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM175 RNA, herein designated VGAM RNA, binds complementarily to one or more host target binding sites located in untranslated regions of VGAM175 host target RNA, herein designated VGAM HOST TARGET RNA. This complementary binding is due to the fact that the nucleotide sequence of VGAM175 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM175 RNA, herein designated VGAM RNA, may have a different number of host target binding sites in untranslated regions of a VGAM175 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM175 RNA, herein designated VGAM RNA, to host target binding sites on VGAM175 host target RNA, herein designated VGAM HOST TARGET RNA, such as BINDING SITE I, BINDING SITE II and BINDING SITE III, inhibits translation of VGAM175 host target RNA, herein designated VGAM HOST TARGET RNA, into VGAM175 host target protein, herein designated VGAM HOST TARGET PROTEIN. VGAM host target protein is therefore outlined by a broken line.

It is appreciated that VGAM175 host target gene, herein designated VGAM HOST TARGET GENE, in fact represents a plurality of VGAM175 host target genes. The mRNA of each one of this plurality of VGAM175 host target genes comprises one or more host target binding sites, each having a nucleotide sequence which is at least partly complementary to VGAM175 RNA, herein designated VGAM RNA, and which when bound by VGAM175 RNA, herein designated VGAM RNA, causes inhibition of translation of respective one or more VGAM175 host target proteins.

It is further appreciated by one skilled in the art that the mode of translational inhibition illustrated by FIG. 1 with specific reference to translational inhibition exerted by VGAM175 gene, herein designated VGAM GENE, on one or more VGAM175 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM175 is inhibition of expression of host target genes, as part of a novel viral mechanism of attacking a host. Accordingly, utilities of VGAM175 include diagnosis, prevention and treatment of viral infection by Vaccinia virus. Specific functions, and accordingly utilities, of VGAM175 correlate with, and may be deduced from, the identity of the host target genes which VGAM175 binds and inhibits, and the function of these host target genes, as elaborated hereinbelow.

Nucleotide sequences of the VGAM175 precursor RNA, herein designated VGAM PRECURSOR RNA, and of the diced VGAM175 RNA, herein designated VGAM RNA, and a schematic representation of the secondary folding of VGAM175 folded precursor RNA, herein designated VGAM FOLDED PRECURSOR RNA, of VGAM175 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM175 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 176 (VGAM176) viral gene, which modulates expression of respective host target genes thereof, the function and utility of which host target genes is known in the art.

VGAM176 is a novel bioinformatically detected regulatory, non protein coding, viral micro RNA (miRNA) gene. The method by which VGAM176 was detected is described hereinabove with reference to FIGS. 2-8.

VGAM176 gene, herein designated VGAM GENE, is a viral gene contained in the genome of Vaccinia virus. VGAM176 host target gene, herein designated VGAM HOST TARGET GENE, is a human gene contained in the human genome.

VGAM176 gene, herein designated VGAM GENE, encodes a VGAM176 precursor RNA, herein designated VGAM PRECURSOR RNA. Similar to other miRNA genes, and unlike most ordinary genes, VGAM176 precursor RNA, herein designated VGAM PRECURSOR RNA, does not encode a protein. A nucleotide sequence identical or highly similar to the nucleotide sequence of VGAM176 precursor RNA is designated SEQ ID:162, and is provided hereinbelow with reference to the sequence listing part. Nucleotide sequence SEQ ID: 162 is located at position 90963 relative to the genome of Vaccinia virus.

VGAM176 precursor RNA, herein designated VGAM PRECURSOR RNA, folds onto itself, forming VGAM176 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM176 folded precursor RNA, herein designated VGAM FOLDED PRECURSOR RNA, into VGAM176 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 78%) nucleotide sequence of VGAM176 RNA is designated SEQ ID:511, and is provided hereinbelow with reference to the sequence listing part.

VGAM176 host target gene, herein designated VGAM HOST TARGET GENE, encodes a corresponding messenger RNA, VGAM176 host target RNA, herein designated VGAM HOST TARGET RNA. VGAM176 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM176 RNA, herein designated VGAM RNA, binds complementarily to one or more host target binding sites located in untranslated regions of VGAM176 host target RNA, herein designated VGAM HOST TARGET RNA. This complementary binding is due to the fact that the nucleotide sequence of VGAM176 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM176 RNA, herein designated VGAM RNA, may have a different number of host target binding sites in untranslated regions of a VGAM176 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM176 RNA, herein designated VGAM RNA, to host target binding sites on VGAM176 host target RNA, herein designated VGAM HOST TARGET RNA, such as BINDING SITE I, BINDING SITE II and BINDING SITE III, inhibits translation of VGAM176 host target RNA, herein designated VGAM HOST TARGET RNA, into VGAM176 host target protein, herein designated VGAM HOST TARGET PROTEIN. VGAM host target protein is therefore outlined by a broken line.

It is appreciated that VGAM176 host target gene, herein designated VGAM HOST TARGET GENE, in fact represents a plurality of VGAM176 host target genes. The mRNA of each one of this plurality of VGAM176 host target genes comprises one or more host target binding sites, each having a nucleotide sequence which is at least partly complementary to VGAM176 RNA, herein designated VGAM RNA, and which when bound by VGAM176 RNA, herein designated VGAM RNA, causes inhibition of translation of respective one or more VGAM176 host target proteins.

It is further appreciated by one skilled in the art that the mode of translational inhibition illustrated by FIG. 1 with specific reference to translational inhibition exerted by VGAM176 gene, herein designated VGAM GENE, on one or more VGAM176 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM176 is inhibition of expression of host target genes, as part of a novel viral mechanism of attacking a host. Accordingly, utilities of VGAM176 include diagnosis, prevention and treatment of viral infection by Vaccinia virus. Specific functions, and accordingly utilities, of VGAM176 correlate with, and may be deduced from, the identity of the host target genes which VGAM176 binds and inhibits, and the function of these host target genes, as elaborated hereinbelow.

Nucleotide sequences of the VGAM176 precursor RNA, herein designated VGAM PRECURSOR RNA, and of the diced VGAM176 RNA, herein designated VGAM RNA, and a schematic representation of the secondary folding of VGAM176 folded precursor RNA, herein designated VGAM FOLDED PRECURSOR RNA, of VGAM176 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM176 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 177 (VGAM177) viral gene, which modulates expression of respective host target genes thereof, the function and utility of which host target genes is known in the art.

VGAM177 is a novel bioinformatically detected regulatory, non protein coding, viral micro RNA (miRNA) gene. The method by which VGAM177 was detected is described hereinabove with reference to FIGS. 2-8.

VGAM177 gene, herein designated VGAM GENE, is a viral gene contained in the genome of Vaccinia virus. VGAM177 host target gene, herein designated VGAM HOST TARGET GENE, is a human gene contained in the human genome.

VGAM177 gene, herein designated VGAM GENE, encodes a VGAM177 precursor RNA, herein designated VGAM PRECURSOR RNA. Similar to other miRNA genes, and unlike most ordinary genes, VGAM177 precursor RNA, herein designated VGAM PRECURSOR RNA, does not encode a protein. A nucleotide sequence identical or highly similar to the nucleotide sequence of VGAM177 precursor RNA is designated SEQ ID:163, and is provided hereinbelow with reference to the sequence listing part. Nucleotide sequence SEQ ID: 163 is located at position 92476 relative to the genome of Vaccinia virus.

VGAM177 precursor RNA, herein designated VGAM PRECURSOR RNA, folds onto itself, forming VGAM177 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM177 folded precursor RNA, herein designated VGAM FOLDED PRECURSOR RNA, into VGAM177 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 72%) nucleotide sequence of VGAM177 RNA is designated SEQ ID:512, and is provided hereinbelow with reference to the sequence listing part.

VGAM177 host target gene, herein designated VGAM HOST TARGET GENE, encodes a corresponding messenger RNA, VGAM177 host target RNA, herein designated VGAM HOST TARGET RNA. VGAM177 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM177 RNA, herein designated VGAM RNA, binds complementarily to one or more host target binding sites located in untranslated regions of VGAM177 host target RNA, herein designated VGAM HOST TARGET RNA. This complementary binding is due to the fact that the nucleotide sequence of VGAM177 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM177 RNA, herein designated VGAM RNA, may have a different number of host target binding sites in untranslated regions of a VGAM177 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM177 RNA, herein designated VGAM RNA, to host target binding sites on VGAM177 host target RNA, herein designated VGAM HOST TARGET RNA, such as BINDING SITE I, BINDING SITE II and BINDING SITE III, inhibits translation of VGAM177 host target RNA, herein designated VGAM HOST TARGET RNA, into VGAM177 host target protein, herein designated VGAM HOST TARGET PROTEIN. VGAM host target protein is therefore outlined by a broken line.

It is appreciated that VGAM177 host target gene, herein designated VGAM HOST TARGET GENE, in fact represents a plurality of VGAM177 host target genes. The mRNA of each one of this plurality of VGAM177 host target genes comprises one or more host target binding sites, each having a nucleotide sequence which is at least partly complementary to VGAM177 RNA, herein designated VGAM RNA, and which when bound by VGAM177 RNA, herein designated VGAM RNA, causes inhibition of translation of respective one or more VGAM177 host target proteins.

It is further appreciated by one skilled in the art that the mode of translational inhibition illustrated by FIG. 1 with specific reference to translational inhibition exerted by VGAM177 gene, herein designated VGAM GENE, on one or more VGAM177 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM177 is inhibition of expression of host target genes, as part of a novel viral mechanism of attacking a host. Accordingly, utilities of VGAM177 include diagnosis, prevention and treatment of viral infection by Vaccinia virus. Specific functions, and accordingly utilities, of VGAM177 correlate with, and may be deduced from, the identity of the host target genes which VGAM177 binds and inhibits, and the function of these host target genes, as elaborated hereinbelow.

Nucleotide sequences of the VGAM177 precursor RNA, herein designated VGAM PRECURSOR RNA, and of the diced VGAM177 RNA, herein designated VGAM RNA, and a schematic representation of the secondary folding of VGAM177 folded precursor RNA, herein designated VGAM FOLDED PRECURSOR RNA, of VGAM177 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM177 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 178 (VGAM178) viral gene, which modulates expression of respective host target genes thereof, the function and utility of which host target genes is known in the art.

VGAM178 is a novel bioinformatically detected regulatory, non protein coding, viral micro RNA (miRNA) gene. The method by which VGAM178 was detected is described hereinabove with reference to FIGS. 2-8.

VGAM178 gene, herein designated VGAM GENE, is a viral gene contained in the genome of Vaccinia virus. VGAM178 host target gene, herein designated VGAM HOST TARGET GENE, is a human gene contained in the human genome.

VGAM178 gene, herein designated VGAM GENE, encodes a VGAM178 precursor RNA, herein designated VGAM PRECURSOR RNA. Similar to other miRNA genes, and unlike most ordinary genes, VGAM178 precursor RNA, herein designated VGAM PRECURSOR RNA, does not encode a protein. A nucleotide sequence identical or highly similar to the nucleotide sequence of VGAM178 precursor RNA is designated SEQ ID:164, and is provided hereinbelow with reference to the sequence listing part. Nucleotide sequence SEQ ID: 164 is located at position 93077 relative to the genome of Vaccinia virus.

VGAM178 precursor RNA, herein designated VGAM PRECURSOR RNA, folds onto itself, forming VGAM178 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM178 folded precursor RNA, herein designated VGAM FOLDED PRECURSOR RNA, into VGAM178 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 86%) nucleotide sequence of VGAM178 RNA is designated SEQ ID:513, and is provided hereinbelow with reference to the sequence listing part.

VGAM178 host target gene, herein designated VGAM HOST TARGET GENE, encodes a corresponding messenger RNA, VGAM178 host target RNA, herein designated VGAM HOST TARGET RNA. VGAM178 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM178 RNA, herein designated VGAM RNA, binds complementarily to one or more host target binding sites located in untranslated regions of VGAM178 host target RNA, herein designated VGAM HOST TARGET RNA. This complementary binding is due to the fact that the nucleotide sequence of VGAM178 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM178 RNA, herein designated VGAM RNA, may have a different number of host target binding sites in untranslated regions of a VGAM178 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM178 RNA, herein designated VGAM RNA, to host target binding sites on VGAM178 host target RNA, herein designated VGAM HOST TARGET RNA, such as BINDING SITE I, BINDING SITE II and BINDING SITE III, inhibits translation of VGAM178 host target RNA, herein designated VGAM HOST TARGET RNA, into VGAM178 host target protein, herein designated VGAM HOST TARGET PROTEIN. VGAM host target protein is therefore outlined by a broken line.

It is appreciated that VGAM178 host target gene, herein designated VGAM HOST TARGET GENE, in fact represents a plurality of VGAM178 host target genes. The mRNA of each one of this plurality of VGAM178 host target genes comprises one or more host target binding sites, each having a nucleotide sequence which is at least partly complementary to VGAM178 RNA, herein designated VGAM RNA, and which when bound by VGAM178 RNA, herein designated VGAM RNA, causes inhibition of translation of respective one or more VGAM178 host target proteins.

It is further appreciated by one skilled in the art that the mode of translational inhibition illustrated by FIG. 1 with specific reference to translational inhibition exerted by VGAM178 gene, herein designated VGAM GENE, on one or more VGAM178 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM178 is inhibition of expression of host target genes, as part of a novel viral mechanism of attacking a host. Accordingly, utilities of VGAM178 include diagnosis, prevention and treatment of viral infection by Vaccinia virus. Specific functions, and accordingly utilities, of VGAM178 correlate with, and may be deduced from, the identity of the host target genes which VGAM178 binds and inhibits, and the function of these host target genes, as elaborated hereinbelow.

Nucleotide sequences of the VGAM178 precursor RNA, herein designated VGAM PRECURSOR RNA, and of the diced VGAM178 RNA, herein designated VGAM RNA, and a schematic representation of the secondary folding of VGAM178 folded precursor RNA, herein designated VGAM FOLDED PRECURSOR RNA, of VGAM178 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM178 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 179 (VGAM179) viral gene, which modulates expression of respective host target genes thereof, the function and utility of which host target genes is known in the art.

VGAM179 is a novel bioinformatically detected regulatory, non protein coding, viral micro RNA (miRNA) gene. The method by which VGAM179 was detected is described hereinabove with reference to FIGS. 2-8.

VGAM179 gene, herein designated VGAM GENE, is a viral gene contained in the genome of Vaccinia virus. VGAM179 host target gene, herein designated VGAM HOST TARGET GENE, is a human gene contained in the human genome.

VGAM179 gene, herein designated VGAM GENE, encodes a VGAM179 precursor RNA, herein designated VGAM PRECURSOR RNA. Similar to other miRNA genes, and unlike most ordinary genes, VGAM179 precursor RNA, herein designated VGAM PRECURSOR RNA, does not encode a protein. A nucleotide sequence identical or highly similar to the nucleotide sequence of VGAM179 precursor RNA is designated SEQ ID:165, and is provided hereinbelow with reference to the sequence listing part. Nucleotide sequence SEQ ID: 165 is located at position 92769 relative to the genome of Vaccinia virus.

VGAM179 precursor RNA, herein designated VGAM PRECURSOR RNA, folds onto itself, forming VGAM179 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM179 folded precursor RNA, herein designated VGAM FOLDED PRECURSOR RNA, into VGAM179 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM179 RNA is designated SEQ ID:514, and is provided hereinbelow with reference to the sequence listing part.

VGAM179 host target gene, herein designated VGAM HOST TARGET GENE, encodes a corresponding messenger RNA, VGAM179 host target RNA, herein designated VGAM HOST TARGET RNA. VGAM179 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM179 RNA, herein designated VGAM RNA, binds complementarily to one or more host target binding sites located in untranslated regions of VGAM179 host target RNA, herein designated VGAM HOST TARGET RNA. This complementary binding is due to the fact that the nucleotide sequence of VGAM179 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM179 RNA, herein designated VGAM RNA, may have a different number of host target binding sites in untranslated regions of a VGAM179 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM179 RNA, herein designated VGAM RNA, to host target binding sites on VGAM179 host target RNA, herein designated VGAM HOST TARGET RNA, such as BINDING SITE I, BINDING SITE II and BINDING SITE III, inhibits translation of VGAM179 host target RNA, herein designated VGAM HOST TARGET RNA, into VGAM179 host target protein, herein designated VGAM HOST TARGET PROTEIN. VGAM host target protein is therefore outlined by a broken line.

It is appreciated that VGAM179 host target gene, herein designated VGAM HOST TARGET GENE, in fact represents a plurality of VGAM179 host target genes. The mRNA of each one of this plurality of VGAM179 host target genes comprises one or more host target binding sites, each having a nucleotide sequence which is at least partly complementary to VGAM179 RNA, herein designated VGAM RNA, and which when bound by VGAM179 RNA, herein designated VGAM RNA, causes inhibition of translation of respective one or more VGAM179 host target proteins.

It is further appreciated by one skilled in the art that the mode of translational inhibition illustrated by FIG. 1 with specific reference to translational inhibition exerted by VGAM179 gene, herein designated VGAM GENE, on one or more VGAM179 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM179 is inhibition of expression of host target genes, as part of a novel viral mechanism of attacking a host. Accordingly, utilities of VGAM179 include diagnosis, prevention and treatment of viral infection by Vaccinia virus. Specific functions, and accordingly utilities, of VGAM179 correlate with, and may be deduced from, the identity of the host target genes which VGAM179 binds and inhibits, and the function of these host target genes, as elaborated hereinbelow.

Nucleotide sequences of the VGAM179 precursor RNA, herein designated VGAM PRECURSOR RNA, and of the diced VGAM179 RNA, herein designated VGAM RNA, and a schematic representation of the secondary folding of VGAM179 folded precursor RNA, herein designated VGAM FOLDED PRECURSOR RNA, of VGAM179 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM179 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 180 (VGAM180) viral gene, which modulates expression of respective host target genes thereof, the function and utility of which host target genes is known in the art.

VGAM180 is a novel bioinformatically detected regulatory, non protein coding, viral micro RNA (miRNA) gene. The method by which VGAM180 was detected is described hereinabove with reference to FIGS. 2-8.

VGAM180 gene, herein designated VGAM GENE, is a viral gene contained in the genome of Vaccinia virus. VGAM180 host target gene, herein designated VGAM HOST TARGET GENE, is a human gene contained in the human genome.

VGAM180 gene, herein designated VGAM GENE, encodes a VGAM180 precursor RNA, herein designated VGAM PRECURSOR RNA. Similar to other miRNA genes, and unlike most ordinary genes, VGAM180 precursor RNA, herein designated VGAM PRECURSOR RNA, does not encode a protein. A nucleotide sequence identical or highly similar to the nucleotide sequence of VGAM180 precursor RNA is designated SEQ ID:166, and is provided hereinbelow with reference to the sequence listing part. Nucleotide sequence SEQ ID: 166 is located at position 93665 relative to the genome of Vaccinia virus.

VGAM180 precursor RNA, herein designated VGAM PRECURSOR RNA, folds onto itself, forming VGAM180 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM180 folded precursor RNA, herein designated VGAM FOLDED PRECURSOR RNA, into VGAM180 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 71%) nucleotide sequence of VGAM180 RNA is designated SEQ ID:515, and is provided hereinbelow with reference to the sequence listing part.

VGAM180 host target gene, herein designated VGAM HOST TARGET GENE, encodes a corresponding messenger RNA, VGAM180 host target RNA, herein designated VGAM HOST TARGET RNA. VGAM180 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM180 RNA, herein designated VGAM RNA, binds complementarily to one or more host target binding sites located in untranslated regions of VGAM180 host target RNA, herein designated VGAM HOST TARGET RNA. This complementary binding is due to the fact that the nucleotide sequence of VGAM180 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM180 RNA, herein designated VGAM RNA, may have a different number of host target binding sites in untranslated regions of a VGAM180 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM180 RNA, herein designated VGAM RNA, to host target binding sites on VGAM180 host target RNA, herein designated VGAM HOST TARGET RNA, such as BINDING SITE I, BINDING SITE II and BINDING SITE III, inhibits translation of VGAM180 host target RNA, herein designated VGAM HOST TARGET RNA, into VGAM180 host target protein, herein designated VGAM HOST TARGET PROTEIN. VGAM host target protein is therefore outlined by a broken line.

It is appreciated that VGAM180 host target gene, herein designated VGAM HOST TARGET GENE, in fact represents a plurality of VGAM180 host target genes. The mRNA of each one of this plurality of VGAM180 host target genes comprises one or more host target binding sites, each having a nucleotide sequence which is at least partly complementary to VGAM180 RNA, herein designated VGAM RNA, and which when bound by VGAM180 RNA, herein designated VGAM RNA, causes inhibition of translation of respective one or more VGAM180 host target proteins.

It is further appreciated by one skilled in the art that the mode of translational inhibition illustrated by FIG. 1 with specific reference to translational inhibition exerted by VGAM180 gene, herein designated VGAM GENE, on one or more VGAM180 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM180 is inhibition of expression of host target genes, as part of a novel viral mechanism of attacking a host. Accordingly, utilities of VGAM180 include diagnosis, prevention and treatment of viral infection by Vaccinia virus. Specific functions, and accordingly utilities, of VGAM180 correlate with, and may be deduced from, the identity of the host target genes which VGAM180 binds and inhibits, and the function of these host target genes, as elaborated hereinbelow.

Nucleotide sequences of the VGAM180 precursor RNA, herein designated VGAM PRECURSOR RNA, and of the diced VGAM180 RNA, herein designated VGAM RNA, and a schematic representation of the secondary folding of VGAM180 folded precursor RNA, herein designated VGAM FOLDED PRECURSOR RNA, of VGAM180 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM180 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 181 (VGAM181) viral gene, which modulates expression of respective host target genes thereof, the function and utility of which host target genes is known in the art.

VGAM181 is a novel bioinformatically detected regulatory, non protein coding, viral micro RNA (miRNA) gene. The method by which VGAM181 was detected is described hereinabove with reference to FIGS. 2-8.

VGAM181 gene, herein designated VGAM GENE, is a viral gene contained in the genome of Vaccinia virus. VGAM181 host target gene, herein designated VGAM HOST TARGET GENE, is a human gene contained in the human genome.

VGAM181 gene, herein designated VGAM GENE, encodes a VGAM181 precursor RNA, herein designated VGAM PRECURSOR RNA. Similar to other miRNA genes, and unlike most ordinary genes, VGAM181 precursor RNA, herein designated VGAM PRECURSOR RNA, does not encode a protein. A nucleotide sequence identical or highly similar to the nucleotide sequence of VGAM181 precursor RNA is designated SEQ ID:167, and is provided hereinbelow with reference to the sequence listing part. Nucleotide sequence SEQ ID: 167 is located at position 96078 relative to the genome of Vaccinia virus.

VGAM181 precursor RNA, herein designated VGAM PRECURSOR RNA, folds onto itself, forming VGAM181 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM181 folded precursor RNA, herein designated VGAM FOLDED PRECURSOR RNA, into VGAM181 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM181 RNA is designated SEQ ID:516, and is provided hereinbelow with reference to the sequence listing part.

VGAM181 host target gene, herein designated VGAM HOST TARGET GENE, encodes a corresponding messenger RNA, VGAM181 host target RNA, herein designated VGAM HOST TARGET RNA. VGAM181 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM181 RNA, herein designated VGAM RNA, binds complementarily to one or more host target binding sites located in untranslated regions of VGAM181 host target RNA, herein designated VGAM HOST TARGET RNA. This complementary binding is due to the fact that the nucleotide sequence of VGAM181 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM181 RNA, herein designated VGAM RNA, may have a different number of host target binding sites in untranslated regions of a VGAM181 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM181 RNA, herein designated VGAM RNA, to host target binding sites on VGAM181 host target RNA, herein designated VGAM HOST TARGET RNA, such as BINDING SITE I, BINDING SITE II and BINDING SITE III, inhibits translation of VGAM181 host target RNA, herein designated VGAM HOST TARGET RNA, into VGAM181 host target protein, herein designated VGAM HOST TARGET PROTEIN. VGAM host target protein is therefore outlined by a broken line.

It is appreciated that VGAM181 host target gene, herein designated VGAM HOST TARGET GENE, in fact represents a plurality of VGAM181 host target genes. The mRNA of each one of this plurality of VGAM181 host target genes comprises one or more host target binding sites, each having a nucleotide sequence which is at least partly complementary to VGAM181 RNA, herein designated VGAM RNA, and which when bound by VGAM181 RNA, herein designated VGAM RNA, causes inhibition of translation of respective one or more VGAM181 host target proteins.

It is further appreciated by one skilled in the art that the mode of translational inhibition illustrated by FIG. 1 with specific reference to translational inhibition exerted by VGAM181 gene, herein designated VGAM GENE, on one or more VGAM181 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM181 is inhibition of expression of host target genes, as part of a novel viral mechanism of attacking a host. Accordingly, utilities of VGAM181 include diagnosis, prevention and treatment of viral infection by Vaccinia virus. Specific functions, and accordingly utilities, of VGAM181 correlate with, and may be deduced from, the identity of the host target genes which VGAM181 binds and inhibits, and the function of these host target genes, as elaborated hereinbelow.

Nucleotide sequences of the VGAM181 precursor RNA, herein designated VGAM PRECURSOR RNA, and of the diced VGAM181 RNA, herein designated VGAM RNA, and a schematic representation of the secondary folding of VGAM181 folded precursor RNA, herein designated VGAM FOLDED PRECURSOR RNA, of VGAM181 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM181 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 182 (VGAM182) viral gene, which modulates expression of respective host target genes thereof, the function and utility of which host target genes is known in the art.

VGAM182 is a novel bioinformatically detected regulatory, non protein coding, viral micro RNA (miRNA) gene. The method by which VGAM182 was detected is described hereinabove with reference to FIGS. 2-8.

VGAM182 gene, herein designated VGAM GENE, is a viral gene contained in the genome of Vaccinia virus. VGAM182 host target gene, herein designated VGAM HOST TARGET GENE, is a human gene contained in the human genome.

VGAM182 gene, herein designated VGAM GENE, encodes a VGAM182 precursor RNA, herein designated VGAM PRECURSOR RNA. Similar to other miRNA genes, and unlike most ordinary genes, VGAM182 precursor RNA, herein designated VGAM PRECURSOR RNA, does not encode a protein. A nucleotide sequence identical or highly similar to the nucleotide sequence of VGAM182 precursor RNA is designated SEQ ID:168, and is provided hereinbelow with reference to the sequence listing part. Nucleotide sequence SEQ ID: 168 is located at position 96777 relative to the genome of Vaccinia virus.

VGAM182 precursor RNA, herein designated VGAM PRECURSOR RNA, folds onto itself, forming VGAM182 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM182 folded precursor RNA, herein designated VGAM FOLDED PRECURSOR RNA, into VGAM182 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 78%) nucleotide sequence of VGAM182 RNA is designated SEQ ID:517, and is provided hereinbelow with reference to the sequence listing part.

VGAM182 host target gene, herein designated VGAM HOST TARGET GENE, encodes a corresponding messenger RNA, VGAM182 host target RNA, herein designated VGAM HOST TARGET RNA. VGAM182 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM182 RNA, herein designated VGAM RNA, binds complementarily to one or more host target binding sites located in untranslated regions of VGAM182 host target RNA, herein designated VGAM HOST TARGET RNA. This complementary binding is due to the fact that the nucleotide sequence of VGAM182 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM182 RNA, herein designated VGAM RNA, may have a different number of host target binding sites in untranslated regions of a VGAM182 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM182 RNA, herein designated VGAM RNA, to host target binding sites on VGAM182 host target RNA, herein designated VGAM HOST TARGET RNA, such as BINDING SITE I, BINDING SITE II and BINDING SITE III, inhibits translation of VGAM182 host target RNA, herein designated VGAM HOST TARGET RNA, into VGAM182 host target protein, herein designated VGAM HOST TARGET PROTEIN. VGAM host target protein is therefore outlined by a broken line.

It is appreciated that VGAM182 host target gene, herein designated VGAM HOST TARGET GENE, in fact represents a plurality of VGAM182 host target genes. The mRNA of each one of this plurality of VGAM182 host target genes comprises one or more host target binding sites, each having a nucleotide sequence which is at least partly complementary to VGAM182 RNA, herein designated VGAM RNA, and which when bound by VGAM182 RNA, herein designated VGAM RNA, causes inhibition of translation of respective one or more VGAM182 host target proteins.

It is further appreciated by one skilled in the art that the mode of translational inhibition illustrated by FIG. 1 with specific reference to translational inhibition exerted by VGAM182 gene, herein designated VGAM GENE, on one or more VGAM182 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM182 is inhibition of expression of host target genes, as part of a novel viral mechanism of attacking a host. Accordingly, utilities of VGAM182 include diagnosis, prevention and treatment of viral infection by Vaccinia virus. Specific functions, and accordingly utilities, of VGAM182 correlate with, and may be deduced from, the identity of the host target genes which VGAM182 binds and inhibits, and the function of these host target genes, as elaborated hereinbelow.

Nucleotide sequences of the VGAM182 precursor RNA, herein designated VGAM PRECURSOR RNA, and of the diced VGAM182 RNA, herein designated VGAM RNA, and a schematic representation of the secondary folding of VGAM182 folded precursor RNA, herein designated VGAM FOLDED PRECURSOR RNA, of VGAM182 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM182 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 183 (VGAM183) viral gene, which modulates expression of respective host target genes thereof, the function and utility of which host target genes is known in the art.

VGAM183 is a novel bioinformatically detected regulatory, non protein coding, viral micro RNA (miRNA) gene. The method by which VGAM183 was detected is described hereinabove with reference to FIGS. 2-8.

VGAM183 gene, herein designated VGAM GENE, is a viral gene contained in the genome of Vaccinia virus. VGAM183 host target gene, herein designated VGAM HOST TARGET GENE, is a human gene contained in the human genome.

VGAM183 gene, herein designated VGAM GENE, encodes a VGAM183 precursor RNA, herein designated VGAM PRECURSOR RNA. Similar to other miRNA genes, and unlike most ordinary genes, VGAM183 precursor RNA, herein designated VGAM PRECURSOR RNA, does not encode a protein. A nucleotide sequence identical or highly similar to the nucleotide sequence of VGAM183 precursor RNA is designated SEQ ID:169, and is provided hereinbelow with reference to the sequence listing part. Nucleotide sequence SEQ ID: 169 is located at position 95430 relative to the genome of Vaccinia virus.

VGAM183 precursor RNA, herein designated VGAM PRECURSOR RNA, folds onto itself, forming VGAM183 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM183 folded precursor RNA, herein designated VGAM FOLDED PRECURSOR RNA, into VGAM183 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 72%) nucleotide sequence of VGAM183 RNA is designated SEQ ID:518, and is provided hereinbelow with reference to the sequence listing part.

VGAM183 host target gene, herein designated VGAM HOST TARGET GENE, encodes a corresponding messenger RNA, VGAM183 host target RNA, herein designated VGAM HOST TARGET RNA. VGAM183 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM183 RNA, herein designated VGAM RNA, binds complementarily to one or more host target binding sites located in untranslated regions of VGAM183 host target RNA, herein designated VGAM HOST TARGET RNA. This complementary binding is due to the fact that the nucleotide sequence of VGAM183 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM183 RNA, herein designated VGAM RNA, may have a different number of host target binding sites in untranslated regions of a VGAM183 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM183 RNA, herein designated VGAM RNA, to host target binding sites on VGAM183 host target RNA, herein designated VGAM HOST TARGET RNA, such as BINDING SITE I, BINDING SITE II and BINDING SITE III, inhibits translation of VGAM183 host target RNA, herein designated VGAM HOST TARGET RNA, into VGAM183 host target protein, herein designated VGAM HOST TARGET PROTEIN. VGAM host target protein is therefore outlined by a broken line.

It is appreciated that VGAM183 host target gene, herein designated VGAM HOST TARGET GENE, in fact represents a plurality of VGAM183 host target genes. The mRNA of each one of this plurality of VGAM183 host target genes comprises one or more host target binding sites, each having a nucleotide sequence which is at least partly complementary to VGAM183 RNA, herein designated VGAM RNA, and which when bound by VGAM183 RNA, herein designated VGAM RNA, causes inhibition of translation of respective one or more VGAM183 host target proteins.

It is further appreciated by one skilled in the art that the mode of translational inhibition illustrated by FIG. 1 with specific reference to translational inhibition exerted by VGAM183 gene, herein designated VGAM GENE, on one or more VGAM183 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM183 is inhibition of expression of host target genes, as part of a novel viral mechanism of attacking a host. Accordingly, utilities of VGAM183 include diagnosis, prevention and treatment of viral infection by Vaccinia virus. Specific functions, and accordingly utilities, of VGAM183 correlate with, and may be deduced from, the identity of the host target genes which VGAM183 binds and inhibits, and the function of these host target genes, as elaborated hereinbelow.

Nucleotide sequences of the VGAM183 precursor RNA, herein designated VGAM PRECURSOR RNA, and of the diced VGAM183 RNA, herein designated VGAM RNA, and a schematic representation of the secondary folding of VGAM183 folded precursor RNA, herein designated VGAM FOLDED PRECURSOR RNA, of VGAM183 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM183 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 184 (VGAM184) viral gene, which modulates expression of respective host target genes thereof, the function and utility of which host target genes is known in the art.

VGAM184 is a novel bioinformatically detected regulatory, non protein coding, viral micro RNA (miRNA) gene. The method by which VGAM184 was detected is described hereinabove with reference to FIGS. 2-8.

VGAM184 gene, herein designated VGAM GENE, is a viral gene contained in the genome of Vaccinia virus. VGAM184 host target gene, herein designated VGAM HOST TARGET GENE, is a human gene contained in the human genome.

VGAM184 gene, herein designated VGAM GENE, encodes a VGAM184 precursor RNA, herein designated VGAM PRECURSOR RNA. Similar to other miRNA genes, and unlike most ordinary genes, VGAM184 precursor RNA, herein designated VGAM PRECURSOR RNA, does not encode a protein. A nucleotide sequence identical or highly similar to the nucleotide sequence of VGAM184 precursor RNA is designated SEQ ID:170, and is provided hereinbelow with reference to the sequence listing part. Nucleotide sequence SEQ ID:170 is located at position 95224 relative to the genome of Vaccinia virus.

VGAM184 precursor RNA, herein designated VGAM PRECURSOR RNA, folds onto itself, forming VGAM184 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM184 folded precursor RNA, herein designated VGAM FOLDED PRECURSOR RNA, into VGAM184 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 89%) nucleotide sequence of VGAM184 RNA is designated SEQ ID:519, and is provided hereinbelow with reference to the sequence listing part.

VGAM184 host target gene, herein designated VGAM HOST TARGET GENE, encodes a corresponding messenger RNA, VGAM184 host target RNA, herein designated VGAM HOST TARGET RNA. VGAM184 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM184 RNA, herein designated VGAM RNA, binds complementarily to one or more host target binding sites located in untranslated regions of VGAM184 host target RNA, herein designated VGAM HOST TARGET RNA. This complementary binding is due to the fact that the nucleotide sequence of VGAM184 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM184 RNA, herein designated VGAM RNA, may have a different number of host target binding sites in untranslated regions of a VGAM184 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM184 RNA, herein designated VGAM RNA, to host target binding sites on VGAM184 host target RNA, herein designated VGAM HOST TARGET RNA, such as BINDING SITE I, BINDING SITE II and BINDING SITE III, inhibits translation of VGAM184 host target RNA, herein designated VGAM HOST TARGET RNA, into VGAM184 host target protein, herein designated VGAM HOST TARGET PROTEIN. VGAM host target protein is therefore outlined by a broken line.

It is appreciated that VGAM184 host target gene, herein designated VGAM HOST TARGET GENE, in fact represents a plurality of VGAM184 host target genes. The mRNA of each one of this plurality of VGAM184 host target genes comprises one or more host target binding sites, each having a nucleotide sequence which is at least partly complementary to VGAM184 RNA, herein designated VGAM RNA, and which when bound by VGAM184 RNA, herein designated VGAM RNA, causes inhibition of translation of respective one or more VGAM184 host target proteins.

It is further appreciated by one skilled in the art that the mode of translational inhibition illustrated by FIG. 1 with specific reference to translational inhibition exerted by VGAM184 gene, herein designated VGAM GENE, on one or more VGAM184 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM184 is inhibition of expression of host target genes, as part of a novel viral mechanism of attacking a host. Accordingly, utilities of VGAM184 include diagnosis, prevention and treatment of viral infection by Vaccinia virus. Specific functions, and accordingly utilities, of VGAM184 correlate with, and may be deduced from, the identity of the host target genes which VGAM184 binds and inhibits, and the function of these host target genes, as elaborated hereinbelow.

Nucleotide sequences of the VGAM184 precursor RNA, herein designated VGAM PRECURSOR RNA, and of the diced VGAM184 RNA, herein designated VGAM RNA, and a schematic representation of the secondary folding of VGAM184 folded precursor RNA, herein designated VGAM FOLDED PRECURSOR RNA, of VGAM184 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM184 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 185 (VGAM185) viral gene, which modulates expression of respective host target genes thereof, the function and utility of which host target genes is known in the art.

VGAM185 is a novel bioinformatically detected regulatory, non protein coding, viral micro RNA (miRNA) gene. The method by which VGAM185 was detected is described hereinabove with reference to FIGS. 2-8.

VGAM185 gene, herein designated VGAM GENE, is a viral gene contained in the genome of Vaccinia virus. VGAM185 host target gene, herein designated VGAM HOST TARGET GENE, is a human gene contained in the human genome.

VGAM185 gene, herein designated VGAM GENE, encodes a VGAM185 precursor RNA, herein designated VGAM PRECURSOR RNA. Similar to other miRNA genes, and unlike most ordinary genes, VGAM185 precursor RNA, herein designated VGAM PRECURSOR RNA, does not encode a protein. A nucleotide sequence identical or highly similar to the nucleotide sequence of VGAM185 precursor RNA is designated SEQ ID:171, and is provided hereinbelow with reference to the sequence listing part. Nucleotide sequence SEQ ID:171 is located at position 97665 relative to the genome of Vaccinia virus.

VGAM185 precursor RNA, herein designated VGAM PRECURSOR RNA, folds onto itself, forming VGAM185 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM185 folded precursor RNA, herein designated VGAM FOLDED PRECURSOR RNA, into VGAM185 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM185 RNA is designated SEQ ID:520, and is provided hereinbelow with reference to the sequence listing part.

VGAM185 host target gene, herein designated VGAM HOST TARGET GENE, encodes a corresponding messenger RNA, VGAM185 host target RNA, herein designated VGAM HOST TARGET RNA. VGAM185 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM185 RNA, herein designated VGAM RNA, binds complementarily to one or more host target binding sites located in untranslated regions of VGAM185 host target RNA, herein designated VGAM HOST TARGET RNA. This complementary binding is due to the fact that the nucleotide sequence of VGAM185 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM185 RNA, herein designated VGAM RNA, may have a different number of host target binding sites in untranslated regions of a VGAM185 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM185 RNA, herein designated VGAM RNA, to host target binding sites on VGAM185 host target RNA, herein designated VGAM HOST TARGET RNA, such as BINDING SITE I, BINDING SITE II and BINDING SITE III, inhibits translation of VGAM185 host target RNA, herein designated VGAM HOST TARGET RNA, into VGAM185 host target protein, herein designated VGAM HOST TARGET PROTEIN. VGAM host target protein is therefore outlined by a broken line.

It is appreciated that VGAM185 host target gene, herein designated VGAM HOST TARGET GENE, in fact represents a plurality of VGAM185 host target genes. The mRNA of each one of this plurality of VGAM185 host target genes comprises one or more host target binding sites, each having a nucleotide sequence which is at least partly complementary to VGAM185 RNA, herein designated VGAM RNA, and which when bound by VGAM185 RNA, herein designated VGAM RNA, causes inhibition of translation of respective one or more VGAM185 host target proteins.

It is further appreciated by one skilled in the art that the mode of translational inhibition illustrated by FIG. 1 with specific reference to translational inhibition exerted by VGAM185 gene, herein designated VGAM GENE, on one or more VGAM185 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM185 is inhibition of expression of host target genes, as part of a novel viral mechanism of attacking a host. Accordingly, utilities of VGAM185 include diagnosis, prevention and treatment of viral infection by Vaccinia virus. Specific functions, and accordingly utilities, of VGAM185 correlate with, and may be deduced from, the identity of the host target genes which VGAM185 binds and inhibits, and the function of these host target genes, as elaborated hereinbelow.

Nucleotide sequences of the VGAM185 precursor RNA, herein designated VGAM PRECURSOR RNA, and of the diced VGAM185 RNA, herein designated VGAM RNA, and a schematic representation of the secondary folding of VGAM185 folded precursor RNA, herein designated VGAM FOLDED PRECURSOR RNA, of VGAM185 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM185 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 186 (VGAM186) viral gene, which modulates expression of respective host target genes thereof, the function and utility of which host target genes is known in the art.

VGAM186 is a novel bioinformatically detected regulatory, non protein coding, viral micro RNA (miRNA) gene. The method by which VGAM186 was detected is described hereinabove with reference to FIGS. 2-8.

VGAM186 gene, herein designated VGAM GENE, is a viral gene contained in the genome of Vaccinia virus. VGAM186 host target gene, herein designated VGAM HOST TARGET GENE, is a human gene contained in the human genome.

VGAM186 gene, herein designated VGAM GENE, encodes a VGAM186 precursor RNA, herein designated VGAM PRECURSOR RNA. Similar to other miRNA genes, and unlike most ordinary genes, VGAM186 precursor RNA, herein designated VGAM PRECURSOR RNA, does not encode a protein. A nucleotide sequence identical or highly similar to the nucleotide sequence of VGAM186 precursor RNA is designated SEQ ID:172, and is provided hereinbelow with reference to the sequence listing part. Nucleotide sequence SEQ ID:172 is located at position 99100 relative to the genome of Vaccinia virus.

VGAM186 precursor RNA, herein designated VGAM PRECURSOR RNA, folds onto itself, forming VGAM186 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM186 folded precursor RNA, herein designated VGAM FOLDED PRECURSOR RNA, into VGAM186 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 94%) nucleotide sequence of VGAM186 RNA is designated SEQ ID:521, and is provided hereinbelow with reference to the sequence listing part.

VGAM186 host target gene, herein designated VGAM HOST TARGET GENE, encodes a corresponding messenger RNA, VGAM186 host target RNA, herein designated VGAM HOST TARGET RNA. VGAM186 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM186 RNA, herein designated VGAM RNA, binds complementarily to one or more host target binding sites located in untranslated regions of VGAM186 host target RNA, herein designated VGAM HOST TARGET RNA. This complementary binding is due to the fact that the nucleotide sequence of VGAM186 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM186 RNA, herein designated VGAM RNA, may have a different number of host target binding sites in untranslated regions of a VGAM186 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM186 RNA, herein designated VGAM RNA, to host target binding sites on VGAM186 host target RNA, herein designated VGAM HOST TARGET RNA, such as BINDING SITE I, BINDING SITE II and BINDING SITE III, inhibits translation of VGAM186 host target RNA, herein designated VGAM HOST TARGET RNA, into VGAM186 host target protein, herein designated VGAM HOST TARGET PROTEIN. VGAM host target protein is therefore outlined by a broken line.

It is appreciated that VGAM186 host target gene, herein designated VGAM HOST TARGET GENE, in fact represents a plurality of VGAM186 host target genes. The mRNA of each one of this plurality of VGAM186 host target genes comprises one or more host target binding sites, each having a nucleotide sequence which is at least partly complementary to VGAM186 RNA, herein designated VGAM RNA, and which when bound by VGAM186 RNA, herein designated VGAM RNA, causes inhibition of translation of respective one or more VGAM186 host target proteins.

It is further appreciated by one skilled in the art that the mode of translational inhibition illustrated by FIG. 1 with specific reference to translational inhibition exerted by VGAM186 gene, herein designated VGAM GENE, on one or more VGAM186 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM186 is inhibition of expression of host target genes, as part of a novel viral mechanism of attacking a host. Accordingly, utilities of VGAM186 include diagnosis, prevention and treatment of viral infection by Vaccinia virus. Specific functions, and accordingly utilities, of VGAM186 correlate with, and may be deduced from, the identity of the host target genes which VGAM186 binds and inhibits, and the function of these host target genes, as elaborated hereinbelow.

Nucleotide sequences of the VGAM186 precursor RNA, herein designated VGAM PRECURSOR RNA, and of the diced VGAM186 RNA, herein designated VGAM RNA, and a schematic representation of the secondary folding of VGAM186 folded precursor RNA, herein designated VGAM FOLDED PRECURSOR RNA, of VGAM186 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM186 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 187 (VGAM187) viral gene, which modulates expression of respective host target genes thereof, the function and utility of which host target genes is known in the art.

VGAM187 is a novel bioinformatically detected regulatory, non protein coding, viral micro RNA (miRNA) gene. The method by which VGAM187 was detected is described hereinabove with reference to FIGS. 2-8.

VGAM187 gene, herein designated VGAM GENE, is a viral gene contained in the genome of Vaccinia virus. VGAM187 host target gene, herein designated VGAM HOST TARGET GENE, is a human gene contained in the human genome.

VGAM187 gene, herein designated VGAM GENE, encodes a VGAM187 precursor RNA, herein designated VGAM PRECURSOR RNA. Similar to other miRNA genes, and unlike most ordinary genes, VGAM187 precursor RNA, herein designated VGAM PRECURSOR RNA, does not encode a protein. A nucleotide sequence identical or highly similar to the nucleotide sequence of VGAM187 precursor RNA is designated SEQ ID:173, and is provided hereinbelow with reference to the sequence listing part. Nucleotide sequence SEQ ID:173 is located at position 98088 relative to the genome of Vaccinia virus.

VGAM187 precursor RNA, herein designated VGAM PRECURSOR RNA, folds onto itself, forming VGAM187 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM187 folded precursor RNA, herein designated VGAM FOLDED PRECURSOR RNA, into VGAM187 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 88%) nucleotide sequence of VGAM187 RNA is designated SEQ ID:522, and is provided hereinbelow with reference to the sequence listing part.

VGAM187 host target gene, herein designated VGAM HOST TARGET GENE, encodes a corresponding messenger RNA, VGAM187 host target RNA, herein designated VGAM HOST TARGET RNA. VGAM187 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM187 RNA, herein designated VGAM RNA, binds complementarily to one or more host target binding sites located in untranslated regions of VGAM187 host target RNA, herein designated VGAM HOST TARGET RNA. This complementary binding is due to the fact that the nucleotide sequence of VGAM187 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM187 RNA, herein designated VGAM RNA, may have a different number of host target binding sites in untranslated regions of a VGAM187 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM187 RNA, herein designated VGAM RNA, to host target binding sites on VGAM187 host target RNA, herein designated VGAM HOST TARGET RNA, such as BINDING SITE I, BINDING SITE II and BINDING SITE III, inhibits translation of VGAM187 host target RNA, herein designated VGAM HOST TARGET RNA, into VGAM187 host target protein, herein designated VGAM HOST TARGET PROTEIN. VGAM host target protein is therefore outlined by a broken line.

It is appreciated that VGAM187 host target gene, herein designated VGAM HOST TARGET GENE, in fact represents a plurality of VGAM187 host target genes. The mRNA of each one of this plurality of VGAM187 host target genes comprises one or more host target binding sites, each having a nucleotide sequence which is at least partly complementary to VGAM187 RNA, herein designated VGAM RNA, and which when bound by VGAM187 RNA, herein designated VGAM RNA, causes inhibition of translation of respective one or more VGAM187 host target proteins.

It is further appreciated by one skilled in the art that the mode of translational inhibition illustrated by FIG. 1 with specific reference to translational inhibition exerted by VGAM187 gene, herein designated VGAM GENE, on one or more VGAM187 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM187 is inhibition of expression of host target genes, as part of a novel viral mechanism of attacking a host. Accordingly, utilities of VGAM187 include diagnosis, prevention and treatment of viral infection by Vaccinia virus. Specific functions, and accordingly utilities, of VGAM187 correlate with, and may be deduced from, the identity of the host target genes which VGAM187 binds and inhibits, and the function of these host target genes, as elaborated hereinbelow.

Nucleotide sequences of the VGAM187 precursor RNA, herein designated VGAM PRECURSOR RNA, and of the diced VGAM187 RNA, herein designated VGAM RNA, and a schematic representation of the secondary folding of VGAM187 folded precursor RNA, herein designated VGAM FOLDED PRECURSOR RNA, of VGAM187 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM187 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 188 (VGAM188) viral gene, which modulates expression of respective host target genes thereof, the function and utility of which host target genes is known in the art.

VGAM188 is a novel bioinformatically detected regulatory, non protein coding, viral micro RNA (miRNA) gene. The method by which VGAM188 was detected is described hereinabove with reference to FIGS. 2-8.

VGAM188 gene, herein designated VGAM GENE, is a viral gene contained in the genome of Vaccinia virus. VGAM188 host target gene, herein designated VGAM HOST TARGET GENE, is a human gene contained in the human genome.

VGAM188 gene, herein designated VGAM GENE, encodes a VGAM188 precursor RNA, herein designated VGAM PRECURSOR RNA. Similar to other miRNA genes, and unlike most ordinary genes, VGAM188 precursor RNA, herein designated VGAM PRECURSOR RNA, does not encode a protein. A nucleotide sequence identical or highly similar to the nucleotide sequence of VGAM188 precursor RNA is designated SEQ ID:174, and is provided hereinbelow with reference to the sequence listing part. Nucleotide sequence SEQ ID:174 is located at position 97335 relative to the genome of Vaccinia virus.

VGAM188 precursor RNA, herein designated VGAM PRECURSOR RNA, folds onto itself, forming VGAM188 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM188 folded precursor RNA, herein designated VGAM FOLDED PRECURSOR RNA, into VGAM188 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM188 RNA is designated SEQ ID:523, and is provided hereinbelow with reference to the sequence listing part.

VGAM188 host target gene, herein designated VGAM HOST TARGET GENE, encodes a corresponding messenger RNA, VGAM188 host target RNA, herein designated VGAM HOST TARGET RNA. VGAM188 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM188 RNA, herein designated VGAM RNA, binds complementarily to one or more host target binding sites located in untranslated regions of VGAM188 host target RNA, herein designated VGAM HOST TARGET RNA. This complementary binding is due to the fact that the nucleotide sequence of VGAM188 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM188 RNA, herein designated VGAM RNA, may have a different number of host target binding sites in untranslated regions of a VGAM188 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM188 RNA, herein designated VGAM RNA, to host target binding sites on VGAM188 host target RNA, herein designated VGAM HOST TARGET RNA, such as BINDING SITE I, BINDING SITE II and BINDING SITE III, inhibits translation of VGAM188 host target RNA, herein designated VGAM HOST TARGET RNA, into VGAM188 host target protein, herein designated VGAM HOST TARGET PROTEIN. VGAM host target protein is therefore outlined by a broken line.

It is appreciated that VGAM188 host target gene, herein designated VGAM HOST TARGET GENE, in fact represents a plurality of VGAM188 host target genes. The mRNA of each one of this plurality of VGAM188 host target genes comprises one or more host target binding sites, each having a nucleotide sequence which is at least partly complementary to VGAM188 RNA, herein designated VGAM RNA, and which when bound by VGAM188 RNA, herein designated VGAM RNA, causes inhibition of translation of respective one or more VGAM188 host target proteins.

It is further appreciated by one skilled in the art that the mode of translational inhibition illustrated by FIG. 1 with specific reference to translational inhibition exerted by VGAM188 gene, herein designated VGAM GENE, on one or more VGAM188 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM188 is inhibition of expression of host target genes, as part of a novel viral mechanism of attacking a host. Accordingly, utilities of VGAM188 include diagnosis, prevention and treatment of viral infection by Vaccinia virus. Specific functions, and accordingly utilities, of VGAM188 correlate with, and may be deduced from, the identity of the host target genes which VGAM188 binds and inhibits, and the function of these host target genes, as elaborated hereinbelow.

Nucleotide sequences of the VGAM188 precursor RNA, herein designated VGAM PRECURSOR RNA, and of the diced VGAM188 RNA, herein designated VGAM RNA, and a schematic representation of the secondary folding of VGAM188 folded precursor RNA, herein designated VGAM FOLDED PRECURSOR RNA, of VGAM188 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM188 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 189 (VGAM189) viral gene, which modulates expression of respective host target genes thereof, the function and utility of which host target genes is known in the art.

VGAM189 is a novel bioinformatically detected regulatory, non protein coding, viral micro RNA (miRNA) gene. The method by which VGAM189 was detected is described hereinabove with reference to FIGS. 2-8.

VGAM189 gene, herein designated VGAM GENE, is a viral gene contained in the genome of Vaccinia virus. VGAM189 host target gene, herein designated VGAM HOST TARGET GENE, is a human gene contained in the human genome.

VGAM189 gene, herein designated VGAM GENE, encodes a VGAM189 precursor RNA, herein designated VGAM PRECURSOR RNA. Similar to other miRNA genes, and unlike most ordinary genes, VGAM189 precursor RNA, herein designated VGAM PRECURSOR RNA, does not encode a protein. A nucleotide sequence identical or highly similar to the nucleotide sequence of VGAM189 precursor RNA is designated SEQ ID:175, and is provided hereinbelow with reference to the sequence listing part. Nucleotide sequence SEQ ID:175 is located at position 96362 relative to the genome of Vaccinia virus.

VGAM189 precursor RNA, herein designated VGAM PRECURSOR RNA, folds onto itself, forming VGAM189 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM189 folded precursor RNA, herein designated VGAM FOLDED PRECURSOR RNA, into VGAM189 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 88%) nucleotide sequence of VGAM189 RNA is designated SEQ ID:524, and is provided hereinbelow with reference to the sequence listing part.

VGAM189 host target gene, herein designated VGAM HOST TARGET GENE, encodes a corresponding messenger RNA, VGAM189 host target RNA, herein designated VGAM HOST TARGET RNA. VGAM189 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM189 RNA, herein designated VGAM RNA, binds complementarily to one or more host target binding sites located in untranslated regions of VGAM189 host target RNA, herein designated VGAM HOST TARGET RNA. This complementary binding is due to the fact that the nucleotide sequence of VGAM189 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM189 RNA, herein designated VGAM RNA, may have a different number of host target binding sites in untranslated regions of a VGAM189 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM189 RNA, herein designated VGAM RNA, to host target binding sites on VGAM189 host target RNA, herein designated VGAM HOST TARGET RNA, such as BINDING SITE I, BINDING SITE II and BINDING SITE III, inhibits translation of VGAM189 host target RNA, herein designated VGAM HOST TARGET RNA, into VGAM189 host target protein, herein designated VGAM HOST TARGET PROTEIN. VGAM host target protein is therefore outlined by a broken line.

It is appreciated that VGAM189 host target gene, herein designated VGAM HOST TARGET GENE, in fact represents a plurality of VGAM189 host target genes. The mRNA of each one of this plurality of VGAM189 host target genes comprises one or more host target binding sites, each having a nucleotide sequence which is at least partly complementary to VGAM189 RNA, herein designated VGAM RNA, and which when bound by VGAM189 RNA, herein designated VGAM RNA, causes inhibition of translation of respective one or more VGAM189 host target proteins.

It is further appreciated by one skilled in the art that the mode of translational inhibition illustrated by FIG. 1 with specific reference to translational inhibition exerted by VGAM189 gene, herein designated VGAM GENE, on one or more VGAM189 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM189 is inhibition of expression of host target genes, as part of a novel viral mechanism of attacking a host. Accordingly, utilities of VGAM189 include diagnosis, prevention and treatment of viral infection by Vaccinia virus. Specific functions, and accordingly utilities, of VGAM189 correlate with, and may be deduced from, the identity of the host target genes which VGAM189 binds and inhibits, and the function of these host target genes, as elaborated hereinbelow.

Nucleotide sequences of the VGAM189 precursor RNA, herein designated VGAM PRECURSOR RNA, and of the diced VGAM189 RNA, herein designated VGAM RNA, and a schematic representation of the secondary folding of VGAM189 folded precursor RNA, herein designated VGAM FOLDED PRECURSOR RNA, of VGAM189 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM189 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 190 (VGAM190) viral gene, which modulates expression of respective host target genes thereof, the function and utility of which host target genes is known in the art.

VGAM190 is a novel bioinformatically detected regulatory, non protein coding, viral micro RNA (miRNA) gene. The method by which VGAM190 was detected is described hereinabove with reference to FIGS. 2-8.

VGAM190 gene, herein designated VGAM GENE, is a viral gene contained in the genome of Vaccinia virus. VGAM190 host target gene, herein designated VGAM HOST TARGET GENE, is a human gene contained in the human genome.

VGAM190 gene, herein designated VGAM GENE, encodes a VGAM190 precursor RNA, herein designated VGAM PRECURSOR RNA. Similar to other miRNA genes, and unlike most ordinary genes, VGAM190 precursor RNA, herein designated VGAM PRECURSOR RNA, does not encode a protein. A nucleotide sequence identical or highly similar to the nucleotide sequence of VGAM190 precursor RNA is designated SEQ ID:176, and is provided hereinbelow with reference to the sequence listing part. Nucleotide sequence SEQ ID:176 is located at position 100470 relative to the genome of Vaccinia virus.

VGAM190 precursor RNA, herein designated VGAM PRECURSOR RNA, folds onto itself, forming VGAM190 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM190 folded precursor RNA, herein designated VGAM FOLDED PRECURSOR RNA, into VGAM190 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 87%) nucleotide sequence of VGAM190 RNA is designated SEQ ID:525, and is provided hereinbelow with reference to the sequence listing part.

VGAM190 host target gene, herein designated VGAM HOST TARGET GENE, encodes a corresponding messenger RNA, VGAM190 host target RNA, herein designated VGAM HOST TARGET RNA. VGAM190 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM190 RNA, herein designated VGAM RNA, binds complementarily to one or more host target binding sites located in untranslated regions of VGAM190 host target RNA, herein designated VGAM HOST TARGET RNA. This complementary binding is due to the fact that the nucleotide sequence of VGAM190 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM190 RNA, herein designated VGAM RNA, may have a different number of host target binding sites in untranslated regions of a VGAM190 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM190 RNA, herein designated VGAM RNA, to host target binding sites on VGAM190 host target RNA, herein designated VGAM HOST TARGET RNA, such as BINDING SITE I, BINDING SITE II and BINDING SITE III, inhibits translation of VGAM190 host target RNA, herein designated VGAM HOST TARGET RNA, into VGAM190 host target protein, herein designated VGAM HOST TARGET PROTEIN. VGAM host target protein is therefore outlined by a broken line.

It is appreciated that VGAM190 host target gene, herein designated VGAM HOST TARGET GENE, in fact represents a plurality of VGAM190 host target genes. The mRNA of each one of this plurality of VGAM190 host target genes comprises one or more host target binding sites, each having a nucleotide sequence which is at least partly complementary to VGAM190 RNA, herein designated VGAM RNA, and which when bound by VGAM190 RNA, herein designated VGAM RNA, causes inhibition of translation of respective one or more VGAM190 host target proteins.

It is further appreciated by one skilled in the art that the mode of translational inhibition illustrated by FIG. 1 with specific reference to translational inhibition exerted by VGAM190 gene, herein designated VGAM GENE, on one or more VGAM190 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM190 is inhibition of expression of host target genes, as part of a novel viral mechanism of attacking a host. Accordingly, utilities of VGAM190 include diagnosis, prevention and treatment of viral infection by Vaccinia virus. Specific functions, and accordingly utilities, of VGAM190 correlate with, and may be deduced from, the identity of the host target genes which VGAM190 binds and inhibits, and the function of these host target genes, as elaborated hereinbelow.

Nucleotide sequences of the VGAM190 precursor RNA, herein designated VGAM PRECURSOR RNA, and of the diced VGAM190 RNA, herein designated VGAM RNA, and a schematic representation of the secondary folding of VGAM190 folded precursor RNA, herein designated VGAM FOLDED PRECURSOR RNA, of VGAM190 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM190 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 191 (VGAM191) viral gene, which modulates expression of respective host target genes thereof, the function and utility of which host target genes is known in the art.

VGAM191 is a novel bioinformatically detected regulatory, non protein coding, viral micro RNA (miRNA) gene. The method by which VGAM191 was detected is described hereinabove with reference to FIGS. 2-8.

VGAM191 gene, herein designated VGAM GENE, is a viral gene contained in the genome of Vaccinia virus. VGAM191 host target gene, herein designated VGAM HOST TARGET GENE, is a human gene contained in the human genome.

VGAM191 gene, herein designated VGAM GENE, encodes a VGAM191 precursor RNA, herein designated VGAM PRECURSOR RNA. Similar to other miRNA genes, and unlike most ordinary genes, VGAM191 precursor RNA, herein designated VGAM PRECURSOR RNA, does not encode a protein. A nucleotide sequence identical or highly similar to the nucleotide sequence of VGAM191 precursor RNA is designated SEQ ID:177, and is provided hereinbelow with reference to the sequence listing part. Nucleotide sequence SEQ ID:177 is located at position 99909 relative to the genome of Vaccinia virus.

VGAM191 precursor RNA, herein designated VGAM PRECURSOR RNA, folds onto itself, forming VGAM191 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM191 folded precursor RNA, herein designated VGAM FOLDED PRECURSOR RNA, into VGAM191 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 90%) nucleotide sequence of VGAM191 RNA is designated SEQ ID:526, and is provided hereinbelow with reference to the sequence listing part.

VGAM191 host target gene, herein designated VGAM HOST TARGET GENE, encodes a corresponding messenger RNA, VGAM191 host target RNA, herein designated VGAM HOST TARGET RNA. VGAM191 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM191 RNA, herein designated VGAM RNA, binds complementarily to one or more host target binding sites located in untranslated regions of VGAM191 host target RNA, herein designated VGAM HOST TARGET RNA. This complementary binding is due to the fact that the nucleotide sequence of VGAM191 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM191 RNA, herein designated VGAM RNA, may have a different number of host target binding sites in untranslated regions of a VGAM191 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM191 RNA, herein designated VGAM RNA, to host target binding sites on VGAM191 host target RNA, herein designated VGAM HOST TARGET RNA, such as BINDING SITE I, BINDING SITE II and BINDING SITE III, inhibits translation of VGAM191 host target RNA, herein designated VGAM HOST TARGET RNA, into VGAM191 host target protein, herein designated VGAM HOST TARGET PROTEIN. VGAM host target protein is therefore outlined by a broken line.

It is appreciated that VGAM191 host target gene, herein designated VGAM HOST TARGET GENE, in fact represents a plurality of VGAM191 host target genes. The mRNA of each one of this plurality of VGAM191 host target genes comprises one or more host target binding sites, each having a nucleotide sequence which is at least partly complementary to VGAM191 RNA, herein designated VGAM RNA, and which when bound by VGAM191 RNA, herein designated VGAM RNA, causes inhibition of translation of respective one or more VGAM191 host target proteins.

It is further appreciated by one skilled in the art that the mode of translational inhibition illustrated by FIG. 1 with specific reference to translational inhibition exerted by VGAM191 gene, herein designated VGAM GENE, on one or more VGAM191 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM191 is inhibition of expression of host target genes, as part of a novel viral mechanism of attacking a host. Accordingly, utilities of VGAM191 include diagnosis, prevention and treatment of viral infection by Vaccinia virus. Specific functions, and accordingly utilities, of VGAM191 correlate with, and may be deduced from, the identity of the host target genes which VGAM191 binds and inhibits, and the function of these host target genes, as elaborated hereinbelow.

Nucleotide sequences of the VGAM191 precursor RNA, herein designated VGAM PRECURSOR RNA, and of the diced VGAM191 RNA, herein designated VGAM RNA, and a schematic representation of the secondary folding of VGAM191 folded precursor RNA, herein designated VGAM FOLDED PRECURSOR RNA, of VGAM191 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM191 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 192 (VGAM192) viral gene, which modulates expression of respective host target genes thereof, the function and utility of which host target genes is known in the art.

VGAM192 is a novel bioinformatically detected regulatory, non protein coding, viral micro RNA (miRNA) gene. The method by which VGAM192 was detected is described hereinabove with reference to FIGS. 2-8.

VGAM192 gene, herein designated VGAM GENE, is a viral gene contained in the genome of Vaccinia virus. VGAM192 host target gene, herein designated VGAM HOST TARGET GENE, is a human gene contained in the human genome.

VGAM192 gene, herein designated VGAM GENE, encodes a VGAM192 precursor RNA, herein designated VGAM PRECURSOR RNA. Similar to other miRNA genes, and unlike most ordinary genes, VGAM192 precursor RNA, herein designated VGAM PRECURSOR RNA, does not encode a protein. A nucleotide sequence identical or highly similar to the nucleotide sequence of VGAM192 precursor RNA is designated SEQ ID:178, and is provided hereinbelow with reference to the sequence listing part. Nucleotide sequence SEQ ID:178 is located at position 102578 relative to the genome of Vaccinia virus.

VGAM192 precursor RNA, herein designated VGAM PRECURSOR RNA, folds onto itself, forming VGAM192 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM192 folded precursor RNA, herein designated VGAM FOLDED PRECURSOR RNA, into VGAM192 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM192 RNA is designated SEQ ID:527, and is provided hereinbelow with reference to the sequence listing part.

VGAM192 host target gene, herein designated VGAM HOST TARGET GENE, encodes a corresponding messenger RNA, VGAM192 host target RNA, herein designated VGAM HOST TARGET RNA. VGAM192 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM192 RNA, herein designated VGAM RNA, binds complementarily to one or more host target binding sites located in untranslated regions of VGAM192 host target RNA, herein designated VGAM HOST TARGET RNA. This complementary binding is due to the fact that the nucleotide sequence of VGAM192 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM192 RNA, herein designated VGAM RNA, may have a different number of host target binding sites in untranslated regions of a VGAM192 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM192 RNA, herein designated VGAM RNA, to host target binding sites on VGAM192 host target RNA, herein designated VGAM HOST TARGET RNA, such as BINDING SITE I, BINDING SITE II and BINDING SITE III, inhibits translation of VGAM192 host target RNA, herein designated VGAM HOST TARGET RNA, into VGAM192 host target protein, herein designated VGAM HOST TARGET PROTEIN. VGAM host target protein is therefore outlined by a broken line.

It is appreciated that VGAM192 host target gene, herein designated VGAM HOST TARGET GENE, in fact represents a plurality of VGAM192 host target genes. The mRNA of each one of this plurality of VGAM192 host target genes comprises one or more host target binding sites, each having a nucleotide sequence which is at least partly complementary to VGAM192 RNA, herein designated VGAM RNA, and which when bound by VGAM192 RNA, herein designated VGAM RNA, causes inhibition of translation of respective one or more VGAM192 host target proteins.

It is further appreciated by one skilled in the art that the mode of translational inhibition illustrated by FIG. 1 with specific reference to translational inhibition exerted by VGAM192 gene, herein designated VGAM GENE, on one or more VGAM192 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM192 is inhibition of expression of host target genes, as part of a novel viral mechanism of attacking a host. Accordingly, utilities of VGAM192 include diagnosis, prevention and treatment of viral infection by Vaccinia virus. Specific functions, and accordingly utilities, of VGAM192 correlate with, and may be deduced from, the identity of the host target genes which VGAM192 binds and inhibits, and the function of these host target genes, as elaborated hereinbelow.

Nucleotide sequences of the VGAM192 precursor RNA, herein designated VGAM PRECURSOR RNA, and of the diced VGAM192 RNA, herein designated VGAM RNA, and a schematic representation of the secondary folding of VGAM192 folded precursor RNA, herein designated VGAM FOLDED PRECURSOR RNA, of VGAM192 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM192 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 193 (VGAM193) viral gene, which modulates expression of respective host target genes thereof, the function and utility of which host target genes is known in the art.

VGAM193 is a novel bioinformatically detected regulatory, non protein coding, viral micro RNA (miRNA) gene. The method by which VGAM193 was detected is described hereinabove with reference to FIGS. 2-8.

VGAM193 gene, herein designated VGAM GENE, is a viral gene contained in the genome of Vaccinia virus. VGAM193 host target gene, herein designated VGAM HOST TARGET GENE, is a human gene contained in the human genome.

VGAM193 gene, herein designated VGAM GENE, encodes a VGAM193 precursor RNA, herein designated VGAM PRECURSOR RNA. Similar to other miRNA genes, and unlike most ordinary genes, VGAM193 precursor RNA, herein designated VGAM PRECURSOR RNA, does not encode a protein. A nucleotide sequence identical or highly similar to the nucleotide sequence of VGAM193 precursor RNA is designated SEQ ID:179, and is provided hereinbelow with reference to the sequence listing part. Nucleotide sequence SEQ ID:179 is located at position 103285 relative to the genome of Vaccinia virus.

VGAM193 precursor RNA, herein designated VGAM PRECURSOR RNA, folds onto itself, forming VGAM193 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM193 folded precursor RNA, herein designated VGAM FOLDED PRECURSOR RNA, into VGAM193 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 90%) nucleotide sequence of VGAM193 RNA is designated SEQ ID:528, and is provided hereinbelow with reference to the sequence listing part.

VGAM193 host target gene, herein designated VGAM HOST TARGET GENE, encodes a corresponding messenger RNA, VGAM193 host target RNA, herein designated VGAM HOST TARGET RNA. VGAM193 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM193 RNA, herein designated VGAM RNA, binds complementarily to one or more host target binding sites located in untranslated regions of VGAM193 host target RNA, herein designated VGAM HOST TARGET RNA. This complementary binding is due to the fact that the nucleotide sequence of VGAM193 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM193 RNA, herein designated VGAM RNA, may have a different number of host target binding sites in untranslated regions of a VGAM193 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM193 RNA, herein designated VGAM RNA, to host target binding sites on VGAM193 host target RNA, herein designated VGAM HOST TARGET RNA, such as BINDING SITE I, BINDING SITE II and BINDING SITE III, inhibits translation of VGAM193 host target RNA, herein designated VGAM HOST TARGET RNA, into VGAM193 host target protein, herein designated VGAM HOST TARGET PROTEIN. VGAM host target protein is therefore outlined by a broken line.

It is appreciated that VGAM193 host target gene, herein designated VGAM HOST TARGET GENE, in fact represents a plurality of VGAM193 host target genes. The mRNA of each one of this plurality of VGAM193 host target genes comprises one or more host target binding sites, each having a nucleotide sequence which is at least partly complementary to VGAM193 RNA, herein designated VGAM RNA, and which when bound by VGAM193 RNA, herein designated VGAM RNA, causes inhibition of translation of respective one or more VGAM193 host target proteins.

It is further appreciated by one skilled in the art that the mode of translational inhibition illustrated by FIG. 1 with specific reference to translational inhibition exerted by VGAM193 gene, herein designated VGAM GENE, on one or more VGAM193 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM193 is inhibition of expression of host target genes, as part of a novel viral mechanism of attacking a host. Accordingly, utilities of VGAM193 include diagnosis, prevention and treatment of viral infection by Vaccinia virus. Specific functions, and accordingly utilities, of VGAM193 correlate with, and may be deduced from, the identity of the host target genes which VGAM193 binds and inhibits, and the function of these host target genes, as elaborated hereinbelow.

Nucleotide sequences of the VGAM193 precursor RNA, herein designated VGAM PRECURSOR RNA, and of the diced VGAM193 RNA, herein designated VGAM RNA, and a schematic representation of the secondary folding of VGAM193 folded precursor RNA, herein designated VGAM FOLDED PRECURSOR RNA, of VGAM193 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM193 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 194 (VGAM194) viral gene, which modulates expression of respective host target genes thereof, the function and utility of which host target genes is known in the art.

VGAM194 is a novel bioinformatically detected regulatory, non protein coding, viral micro RNA (miRNA) gene. The method by which VGAM194 was detected is described hereinabove with reference to FIGS. 2-8.

VGAM194 gene, herein designated VGAM GENE, is a viral gene contained in the genome of Vaccinia virus. VGAM194 host target gene, herein designated VGAM HOST TARGET GENE, is a human gene contained in the human genome.

VGAM194 gene, herein designated VGAM GENE, encodes a VGAM194 precursor RNA, herein designated VGAM PRECURSOR RNA. Similar to other miRNA genes, and unlike most ordinary genes, VGAM194 precursor RNA, herein designated VGAM PRECURSOR RNA, does not encode a protein. A nucleotide sequence identical or highly similar to the nucleotide sequence of VGAM194 precursor RNA is designated SEQ ID:180, and is provided hereinbelow with reference to the sequence listing part. Nucleotide sequence SEQ ID:180 is located at position 103379 relative to the genome of Vaccinia virus.

VGAM194 precursor RNA, herein designated VGAM PRECURSOR RNA, folds onto itself, forming VGAM194 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM194 folded precursor RNA, herein designated VGAM FOLDED PRECURSOR RNA, into VGAM194 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 88%) nucleotide sequence of VGAM194 RNA is designated SEQ ID:529, and is provided hereinbelow with reference to the sequence listing part.

VGAM194 host target gene, herein designated VGAM HOST TARGET GENE, encodes a corresponding messenger RNA, VGAM194 host target RNA, herein designated VGAM HOST TARGET RNA. VGAM194 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM194 RNA, herein designated VGAM RNA, binds complementarily to one or more host target binding sites located in untranslated regions of VGAM194 host target RNA, herein designated VGAM HOST TARGET RNA. This complementary binding is due to the fact that the nucleotide sequence of VGAM194 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM194 RNA, herein designated VGAM RNA, may have a different number of host target binding sites in untranslated regions of a VGAM194 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM194 RNA, herein designated VGAM RNA, to host target binding sites on VGAM194 host target RNA, herein designated VGAM HOST TARGET RNA, such as BINDING SITE I, BINDING SITE II and BINDING SITE III, inhibits translation of VGAM194 host target RNA, herein designated VGAM HOST TARGET RNA, into VGAM194 host target protein, herein designated VGAM HOST TARGET PROTEIN. VGAM host target protein is therefore outlined by a broken line.

It is appreciated that VGAM194 host target gene, herein designated VGAM HOST TARGET GENE, in fact represents a plurality of VGAM194 host target genes. The mRNA of each one of this plurality of VGAM194 host target genes comprises one or more host target binding sites, each having a nucleotide sequence which is at least partly complementary to VGAM194 RNA, herein designated VGAM RNA, and which when bound by VGAM194 RNA, herein designated VGAM RNA, causes inhibition of translation of respective one or more VGAM194 host target proteins.

It is further appreciated by one skilled in the art that the mode of translational inhibition illustrated by FIG. 1 with specific reference to translational inhibition exerted by VGAM194 gene, herein designated VGAM GENE, on one or more VGAM194 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM194 is inhibition of expression of host target genes, as part of a novel viral mechanism of attacking a host. Accordingly, utilities of VGAM194 include diagnosis, prevention and treatment of viral infection by Vaccinia virus. Specific functions, and accordingly utilities, of VGAM194 correlate with, and may be deduced from, the identity of the host target genes which VGAM194 binds and inhibits, and the function of these host target genes, as elaborated hereinbelow.

Nucleotide sequences of the VGAM194 precursor RNA, herein designated VGAM PRECURSOR RNA, and of the diced VGAM194 RNA, herein designated VGAM RNA, and a schematic representation of the secondary folding of VGAM194 folded precursor RNA, herein designated VGAM FOLDED PRECURSOR RNA, of VGAM194 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM194 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 195 (VGAM195) viral gene, which modulates expression of respective host target genes thereof, the function and utility of which host target genes is known in the art.

VGAM195 is a novel bioinformatically detected regulatory, non protein coding, viral micro RNA (miRNA) gene. The method by which VGAM195 was detected is described hereinabove with reference to FIGS. 2-8.

VGAM195 gene, herein designated VGAM GENE, is a viral gene contained in the genome of Vaccinia virus. VGAM195 host target gene, herein designated VGAM HOST TARGET GENE, is a human gene contained in the human genome.

VGAM195 gene, herein designated VGAM GENE, encodes a VGAM195 precursor RNA, herein designated VGAM PRECURSOR RNA. Similar to other miRNA genes, and unlike most ordinary genes, VGAM195 precursor RNA, herein designated VGAM PRECURSOR RNA, does not encode a protein. A nucleotide sequence identical or highly similar to the nucleotide sequence of VGAM195 precursor RNA is designated SEQ ID:181, and is provided hereinbelow with reference to the sequence listing part. Nucleotide sequence SEQ ID:181 is located at position 105936 relative to the genome of Vaccinia virus.

VGAM195 precursor RNA, herein designated VGAM PRECURSOR RNA, folds onto itself, forming VGAM195 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM195 folded precursor RNA, herein designated VGAM FOLDED PRECURSOR RNA, into VGAM195 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 87%) nucleotide sequence of VGAM195 RNA is designated SEQ ID:530, and is provided hereinbelow with reference to the sequence listing part.

VGAM195 host target gene, herein designated VGAM HOST TARGET GENE, encodes a corresponding messenger RNA, VGAM195 host target RNA, herein designated VGAM HOST TARGET RNA. VGAM195 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM195 RNA, herein designated VGAM RNA, binds complementarily to one or more host target binding sites located in untranslated regions of VGAM195 host target RNA, herein designated VGAM HOST TARGET RNA. This complementary binding is due to the fact that the nucleotide sequence of VGAM195 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM195 RNA, herein designated VGAM RNA, may have a different number of host target binding sites in untranslated regions of a VGAM195 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM195 RNA, herein designated VGAM RNA, to host target binding sites on VGAM195 host target RNA, herein designated VGAM HOST TARGET RNA, such as BINDING SITE I, BINDING SITE II and BINDING SITE III, inhibits translation of VGAM195 host target RNA, herein designated VGAM HOST TARGET RNA, into VGAM195 host target protein, herein designated VGAM HOST TARGET PROTEIN. VGAM host target protein is therefore outlined by a broken line.

It is appreciated that VGAM195 host target gene, herein designated VGAM HOST TARGET GENE, in fact represents a plurality of VGAM195 host target genes. The mRNA of each one of this plurality of VGAM195 host target genes comprises one or more host target binding sites, each having a nucleotide sequence which is at least partly complementary to VGAM195 RNA, herein designated VGAM RNA, and which when bound by VGAM195 RNA, herein designated VGAM RNA, causes inhibition of translation of respective one or more VGAM195 host target proteins.

It is further appreciated by one skilled in the art that the mode of translational inhibition illustrated by FIG. 1 with specific reference to translational inhibition exerted by VGAM195 gene, herein designated VGAM GENE, on one or more VGAM195 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM195 is inhibition of expression of host target genes, as part of a novel viral mechanism of attacking a host. Accordingly, utilities of VGAM195 include diagnosis, prevention and treatment of viral infection by Vaccinia virus. Specific functions, and accordingly utilities, of VGAM195 correlate with, and may be deduced from, the identity of the host target genes which VGAM195 binds and inhibits, and the function of these host target genes, as elaborated hereinbelow.

Nucleotide sequences of the VGAM195 precursor RNA, herein designated VGAM PRECURSOR RNA, and of the diced VGAM195 RNA, herein designated VGAM RNA, and a schematic representation of the secondary folding of VGAM195 folded precursor RNA, herein designated VGAM FOLDED PRECURSOR RNA, of VGAM195 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM195 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 196 (VGAM196) viral gene, which modulates expression of respective host target genes thereof, the function and utility of which host target genes is known in the art.

VGAM196 is a novel bioinformatically detected regulatory, non protein coding, viral micro RNA (miRNA) gene. The method by which VGAM196 was detected is described hereinabove with reference to FIGS. 2-8.

VGAM196 gene, herein designated VGAM GENE, is a viral gene contained in the genome of Vaccinia virus. VGAM196 host target gene, herein designated VGAM HOST TARGET GENE, is a human gene contained in the human genome.

VGAM196 gene, herein designated VGAM GENE, encodes a VGAM196 precursor RNA, herein designated VGAM PRECURSOR RNA. Similar to other miRNA genes, and unlike most ordinary genes, VGAM196 precursor RNA, herein designated VGAM PRECURSOR RNA, does not encode a protein. A nucleotide sequence identical or highly similar to the nucleotide sequence of VGAM196 precursor RNA is designated SEQ ID:182, and is provided hereinbelow with reference to the sequence listing part. Nucleotide sequence SEQ ID:182 is located at position 103914 relative to the genome of Vaccinia virus.

VGAM196 precursor RNA, herein designated VGAM PRECURSOR RNA, folds onto itself, forming VGAM196 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM196 folded precursor RNA, herein designated VGAM FOLDED PRECURSOR RNA, into VGAM196 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM196 RNA is designated SEQ ID:531, and is provided hereinbelow with reference to the sequence listing part.

VGAM196 host target gene, herein designated VGAM HOST TARGET GENE, encodes a corresponding messenger RNA, VGAM196 host target RNA, herein designated VGAM HOST TARGET RNA. VGAM196 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM196 RNA, herein designated VGAM RNA, binds complementarily to one or more host target binding sites located in untranslated regions of VGAM196 host target RNA, herein designated VGAM HOST TARGET RNA. This complementary binding is due to the fact that the nucleotide sequence of VGAM196 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM196 RNA, herein designated VGAM RNA, may have a different number of host target binding sites in untranslated regions of a VGAM196 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM196 RNA, herein designated VGAM RNA, to host target binding sites on VGAM196 host target RNA, herein designated VGAM HOST TARGET RNA, such as BINDING SITE I, BINDING SITE II and BINDING SITE III, inhibits translation of VGAM196 host target RNA, herein designated VGAM HOST TARGET RNA, into VGAM196 host target protein, herein designated VGAM HOST TARGET PROTEIN. VGAM host target protein is therefore outlined by a broken line.

It is appreciated that VGAM196 host target gene, herein designated VGAM HOST TARGET GENE, in fact represents a plurality of VGAM196 host target genes. The mRNA of each one of this plurality of VGAM196 host target genes comprises one or more host target binding sites, each having a nucleotide sequence which is at least partly complementary to VGAM196 RNA, herein designated VGAM RNA, and which when bound by VGAM196 RNA, herein designated VGAM RNA, causes inhibition of translation of respective one or more VGAM196 host target proteins.

It is further appreciated by one skilled in the art that the mode of translational inhibition illustrated by FIG. 1 with specific reference to translational inhibition exerted by VGAM196 gene, herein designated VGAM GENE, on one or more VGAM196 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM196 is inhibition of expression of host target genes, as part of a novel viral mechanism of attacking a host. Accordingly, utilities of VGAM196 include diagnosis, prevention and treatment of viral infection by Vaccinia virus. Specific functions, and accordingly utilities, of VGAM196 correlate with, and may be deduced from, the identity of the host target genes which VGAM196 binds and inhibits, and the function of these host target genes, as elaborated hereinbelow.

Nucleotide sequences of the VGAM196 precursor RNA, herein designated VGAM PRECURSOR RNA, and of the diced VGAM196 RNA, herein designated VGAM RNA, and a schematic representation of the secondary folding of VGAM196 folded precursor RNA, herein designated VGAM FOLDED PRECURSOR RNA, of VGAM196 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM196 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 197 (VGAM197) viral gene, which modulates expression of respective host target genes thereof, the function and utility of which host target genes is known in the art.

VGAM197 is a novel bioinformatically detected regulatory, non protein coding, viral micro RNA (miRNA) gene. The method by which VGAM197 was detected is described hereinabove with reference to FIGS. 2-8.

VGAM197 gene, herein designated VGAM GENE, is a viral gene contained in the genome of Vaccinia virus. VGAM197 host target gene, herein designated VGAM HOST TARGET GENE, is a human gene contained in the human genome.

VGAM197 gene, herein designated VGAM GENE, encodes a VGAM197 precursor RNA, herein designated VGAM PRECURSOR RNA. Similar to other miRNA genes, and unlike most ordinary genes, VGAM197 precursor RNA, herein designated VGAM PRECURSOR RNA, does not encode a protein. A nucleotide sequence identical or highly similar to the nucleotide sequence of VGAM197 precursor RNA is designated SEQ ID:183, and is provided hereinbelow with reference to the sequence listing part. Nucleotide sequence SEQ ID:183 is located at position 104417 relative to the genome of Vaccinia virus.

VGAM197 precursor RNA, herein designated VGAM PRECURSOR RNA, folds onto itself, forming VGAM197 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM197 folded precursor RNA, herein designated VGAM FOLDED PRECURSOR RNA, into VGAM197 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM197 RNA is designated SEQ ID:532, and is provided hereinbelow with reference to the sequence listing part.

VGAM197 host target gene, herein designated VGAM HOST TARGET GENE, encodes a corresponding messenger RNA, VGAM197 host target RNA, herein designated VGAM HOST TARGET RNA. VGAM197 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM197 RNA, herein designated VGAM RNA, binds complementarily to one or more host target binding sites located in untranslated regions of VGAM197 host target RNA, herein designated VGAM HOST TARGET RNA. This complementary binding is due to the fact that the nucleotide sequence of VGAM197 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM197 RNA, herein designated VGAM RNA, may have a different number of host target binding sites in untranslated regions of a VGAM197 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM197 RNA, herein designated VGAM RNA, to host target binding sites on VGAM197 host target RNA, herein designated VGAM HOST TARGET RNA, such as BINDING SITE I, BINDING SITE II and BINDING SITE III, inhibits translation of VGAM197 host target RNA, herein designated VGAM HOST TARGET RNA, into VGAM197 host target protein, herein designated VGAM HOST TARGET PROTEIN. VGAM host target protein is therefore outlined by a broken line.

It is appreciated that VGAM197 host target gene, herein designated VGAM HOST TARGET GENE, in fact represents a plurality of VGAM197 host target genes. The mRNA of each one of this plurality of VGAM197 host target genes comprises one or more host target binding sites, each having a nucleotide sequence which is at least partly complementary to VGAM197 RNA, herein designated VGAM RNA, and which when bound by VGAM197 RNA, herein designated VGAM RNA, causes inhibition of translation of respective one or more VGAM197 host target proteins.

It is further appreciated by one skilled in the art that the mode of translational inhibition illustrated by FIG. 1 with specific reference to translational inhibition exerted by VGAM197 gene, herein designated VGAM GENE, on one or more VGAM197 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM197 is inhibition of expression of host target genes, as part of a novel viral mechanism of attacking a host. Accordingly, utilities of VGAM197 include diagnosis, prevention and treatment of viral infection by Vaccinia virus. Specific functions, and accordingly utilities, of VGAM197 correlate with, and may be deduced from, the identity of the host target genes which VGAM197 binds and inhibits, and the function of these host target genes, as elaborated hereinbelow.

Nucleotide sequences of the VGAM197 precursor RNA, herein designated VGAM PRECURSOR RNA, and of the diced VGAM197 RNA, herein designated VGAM RNA, and a schematic representation of the secondary folding of VGAM197 folded precursor RNA, herein designated VGAM FOLDED PRECURSOR RNA, of VGAM197 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM197 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 198 (VGAM198) viral gene, which modulates expression of respective host target genes thereof, the function and utility of which host target genes is known in the art.

VGAM198 is a novel bioinformatically detected regulatory, non protein coding, viral micro RNA (miRNA) gene. The method by which VGAM198 was detected is described hereinabove with reference to FIGS. 2-8.

VGAM198 gene, herein designated VGAM GENE, is a viral gene contained in the genome of Vaccinia virus. VGAM198 host target gene, herein designated VGAM HOST TARGET GENE, is a human gene contained in the human genome.

VGAM198 gene, herein designated VGAM GENE, encodes a VGAM198 precursor RNA, herein designated VGAM PRECURSOR RNA. Similar to other miRNA genes, and unlike most ordinary genes, VGAM198 precursor RNA, herein designated VGAM PRECURSOR RNA, does not encode a protein. A nucleotide sequence identical or highly similar to the nucleotide sequence of VGAM198 precursor RNA is designated SEQ ID:184, and is provided hereinbelow with reference to the sequence listing part. Nucleotide sequence SEQ ID:184 is located at position 106759 relative to the genome of Vaccinia virus.

VGAM198 precursor RNA, herein designated VGAM PRECURSOR RNA, folds onto itself, forming VGAM198 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM198 folded precursor RNA, herein designated VGAM FOLDED PRECURSOR RNA, into VGAM198 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 25%) nucleotide sequence of VGAM198 RNA is designated SEQ ID:533, and is provided hereinbelow with reference to the sequence listing part.

VGAM198 host target gene, herein designated VGAM HOST TARGET GENE, encodes a corresponding messenger RNA, VGAM198 host target RNA, herein designated VGAM HOST TARGET RNA. VGAM198 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM198 RNA, herein designated VGAM RNA, binds complementarily to one or more host target binding sites located in untranslated regions of VGAM198 host target RNA, herein designated VGAM HOST TARGET RNA. This complementary binding is due to the fact that the nucleotide sequence of VGAM198 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM198 RNA, herein designated VGAM RNA, may have a different number of host target binding sites in untranslated regions of a VGAM198 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM198 RNA, herein designated VGAM RNA, to host target binding sites on VGAM198 host target RNA, herein designated VGAM HOST TARGET RNA, such as BINDING SITE I, BINDING SITE II and BINDING SITE III, inhibits translation of VGAM198 host target RNA, herein designated VGAM HOST TARGET RNA, into VGAM198 host target protein, herein designated VGAM HOST TARGET PROTEIN. VGAM host target protein is therefore outlined by a broken line.

It is appreciated that VGAM198 host target gene, herein designated VGAM HOST TARGET GENE, in fact represents a plurality of VGAM198 host target genes. The mRNA of each one of this plurality of VGAM198 host target genes comprises one or more host target binding sites, each having a nucleotide sequence which is at least partly complementary to VGAM198 RNA, herein designated VGAM RNA, and which when bound by VGAM198 RNA, herein designated VGAM RNA, causes inhibition of translation of respective one or more VGAM198 host target proteins.

It is further appreciated by one skilled in the art that the mode of translational inhibition illustrated by FIG. 1 with specific reference to translational inhibition exerted by VGAM198 gene, herein designated VGAM GENE, on one or more VGAM198 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM198 is inhibition of expression of host target genes, as part of a novel viral mechanism of attacking a host. Accordingly, utilities of VGAM198 include diagnosis, prevention and treatment of viral infection by Vaccinia virus. Specific functions, and accordingly utilities, of VGAM198 correlate with, and may be deduced from, the identity of the host target genes which VGAM198 binds and inhibits, and the function of these host target genes, as elaborated hereinbelow.

Nucleotide sequences of the VGAM198 precursor RNA, herein designated VGAM PRECURSOR RNA, and of the diced VGAM198 RNA, herein designated VGAM RNA, and a schematic representation of the secondary folding of VGAM198 folded precursor RNA, herein designated VGAM FOLDED PRECURSOR RNA, of VGAM198 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM198 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 199 (VGAM199) viral gene, which modulates expression of respective host target genes thereof, the function and utility of which host target genes is known in the art.

VGAM199 is a novel bioinformatically detected regulatory, non protein coding, viral micro RNA (miRNA) gene. The method by which VGAM199 was detected is described hereinabove with reference to FIGS. 2-8.

VGAM199 gene, herein designated VGAM GENE, is a viral gene contained in the genome of Vaccinia virus. VGAM199 host target gene, herein designated VGAM HOST TARGET GENE, is a human gene contained in the human genome.

VGAM199 gene, herein designated VGAM GENE, encodes a VGAM199 precursor RNA, herein designated VGAM PRECURSOR RNA. Similar to other miRNA genes, and unlike most ordinary genes, VGAM199 precursor RNA, herein designated VGAM PRECURSOR RNA, does not encode a protein. A nucleotide sequence identical or highly similar to the nucleotide sequence of VGAM199 precursor RNA is designated SEQ ID:185, and is provided hereinbelow with reference to the sequence listing part. Nucleotide sequence SEQ ID:185 is located at position 106596 relative to the genome of Vaccinia virus.

VGAM199 precursor RNA, herein designated VGAM PRECURSOR RNA, folds onto itself, forming VGAM199 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM199 folded precursor RNA, herein designated VGAM FOLDED PRECURSOR RNA, into VGAM199 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 78%) nucleotide sequence of VGAM199 RNA is designated SEQ ID:534, and is provided hereinbelow with reference to the sequence listing part.

VGAM199 host target gene, herein designated VGAM HOST TARGET GENE, encodes a corresponding messenger RNA, VGAM199 host target RNA, herein designated VGAM HOST TARGET RNA. VGAM199 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM199 RNA, herein designated VGAM RNA, binds complementarily to one or more host target binding sites located in untranslated regions of VGAM199 host target RNA, herein designated VGAM HOST TARGET RNA. This complementary binding is due to the fact that the nucleotide sequence of VGAM199 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM199 RNA, herein designated VGAM RNA, may have a different number of host target binding sites in untranslated regions of a VGAM199 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM199 RNA, herein designated VGAM RNA, to host target binding sites on VGAM199 host target RNA, herein designated VGAM HOST TARGET RNA, such as BINDING SITE I, BINDING SITE II and BINDING SITE III, inhibits translation of VGAM199 host target RNA, herein designated VGAM HOST TARGET RNA, into VGAM199 host target protein, herein designated VGAM HOST TARGET PROTEIN. VGAM host target protein is therefore outlined by a broken line.

It is appreciated that VGAM199 host target gene, herein designated VGAM HOST TARGET GENE, in fact represents a plurality of VGAM199 host target genes. The mRNA of each one of this plurality of VGAM199 host target genes comprises one or more host target binding sites, each having a nucleotide sequence which is at least partly complementary to VGAM199 RNA, herein designated VGAM RNA, and which when bound by VGAM199 RNA, herein designated VGAM RNA, causes inhibition of translation of respective one or more VGAM199 host target proteins.

It is further appreciated by one skilled in the art that the mode of translational inhibition illustrated by FIG. 1 with specific reference to translational inhibition exerted by VGAM199 gene, herein designated VGAM GENE, on one or more VGAM199 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM199 is inhibition of expression of host target genes, as part of a novel viral mechanism of attacking a host. Accordingly, utilities of VGAM199 include diagnosis, prevention and treatment of viral infection by Vaccinia virus. Specific functions, and accordingly utilities, of VGAM199 correlate with, and may be deduced from, the identity of the host target genes which VGAM199 binds and inhibits, and the function of these host target genes, as elaborated hereinbelow.

Nucleotide sequences of the VGAM199 precursor RNA, herein designated VGAM PRECURSOR RNA, and of the diced VGAM199 RNA, herein designated VGAM RNA, and a schematic representation of the secondary folding of VGAM199 folded precursor RNA, herein designated VGAM FOLDED PRECURSOR RNA, of VGAM199 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM199 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 200 (VGAM200) viral gene, which modulates expression of respective host target genes thereof, the function and utility of which host target genes is known in the art.

VGAM200 is a novel bioinformatically detected regulatory, non protein coding, viral micro RNA (miRNA) gene. The method by which VGAM200 was detected is described hereinabove with reference to FIGS. 2-8.

VGAM200 gene, herein designated VGAM GENE, is a viral gene contained in the genome of Vaccinia virus. VGAM200 host target gene, herein designated VGAM HOST TARGET GENE, is a human gene contained in the human genome.

VGAM200 gene, herein designated VGAM GENE, encodes a VGAM200 precursor RNA, herein designated VGAM PRECURSOR RNA. Similar to other miRNA genes, and unlike most ordinary genes, VGAM200 precursor RNA, herein designated VGAM PRECURSOR RNA, does not encode a protein. A nucleotide sequence identical or highly similar to the nucleotide sequence of VGAM200 precursor RNA is designated SEQ ID:186, and is provided hereinbelow with reference to the sequence listing part. Nucleotide sequence SEQ ID:186 is located at position 106423 relative to the genome of Vaccinia virus.

VGAM200 precursor RNA, herein designated VGAM PRECURSOR RNA, folds onto itself, forming VGAM200 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM200 folded precursor RNA, herein designated VGAM FOLDED PRECURSOR RNA, into VGAM200 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM200 RNA is designated SEQ ID:535, and is provided hereinbelow with reference to the sequence listing part.

VGAM200 host target gene, herein designated VGAM HOST TARGET GENE, encodes a corresponding messenger RNA, VGAM200 host target RNA, herein designated VGAM HOST TARGET RNA. VGAM200 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM200 RNA, herein designated VGAM RNA, binds complementarily to one or more host target binding sites located in untranslated regions of VGAM200 host target RNA, herein designated VGAM HOST TARGET RNA. This complementary binding is due to the fact that the nucleotide sequence of VGAM200 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM200 RNA, herein designated VGAM RNA, may have a different number of host target binding sites in untranslated regions of a VGAM200 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM200 RNA, herein designated VGAM RNA, to host target binding sites on VGAM200 host target RNA, herein designated VGAM HOST TARGET RNA, such as BINDING SITE I, BINDING SITE II and BINDING SITE III, inhibits translation of VGAM200 host target RNA, herein designated VGAM HOST TARGET RNA, into VGAM200 host target protein, herein designated VGAM HOST TARGET PROTEIN. VGAM host target protein is therefore outlined by a broken line.

It is appreciated that VGAM200 host target gene, herein designated VGAM HOST TARGET GENE, in fact represents a plurality of VGAM200 host target genes. The mRNA of each one of this plurality of VGAM200 host target genes comprises one or more host target binding sites, each having a nucleotide sequence which is at least partly complementary to VGAM200 RNA, herein designated VGAM RNA, and which when bound by VGAM200 RNA, herein designated VGAM RNA, causes inhibition of translation of respective one or more VGAM200 host target proteins.

It is further appreciated by one skilled in the art that the mode of translational inhibition illustrated by FIG. 1 with specific reference to translational inhibition exerted by VGAM200 gene, herein designated VGAM GENE, on one or more VGAM200 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM200 is inhibition of expression of host target genes, as part of a novel viral mechanism of attacking a host. Accordingly, utilities of VGAM200 include diagnosis, prevention and treatment of viral infection by Vaccinia virus. Specific functions, and accordingly utilities, of VGAM200 correlate with, and may be deduced from, the identity of the host target genes which VGAM200 binds and inhibits, and the function of these host target genes, as elaborated hereinbelow.

Nucleotide sequences of the VGAM200 precursor RNA, herein designated VGAM PRECURSOR RNA, and of the diced VGAM200 RNA, herein designated VGAM RNA, and a schematic representation of the secondary folding of VGAM200 folded precursor RNA, herein designated VGAM FOLDED PRECURSOR RNA, of VGAM200 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM200 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 201 (VGAM201) viral gene, which modulates expression of respective host target genes thereof, the function and utility of which host target genes is known in the art.

VGAM201 is a novel bioinformatically detected regulatory, non protein coding, viral micro RNA (miRNA) gene. The method by which VGAM201 was detected is described hereinabove with reference to FIGS. 2-8.

VGAM201 gene, herein designated VGAM GENE, is a viral gene contained in the genome of Vaccinia virus.

VGAM201 host target gene, herein designated VGAM HOST TARGET GENE, is a human gene contained in the human genome.

VGAM201 gene, herein designated VGAM GENE, encodes a VGAM201 precursor RNA, herein designated VGAM PRECURSOR RNA. Similar to other miRNA genes, and unlike most ordinary genes, VGAM201 precursor RNA, herein designated VGAM PRECURSOR RNA, does not encode a protein. A nucleotide sequence identical or highly similar to the nucleotide sequence of VGAM201 precursor RNA is designated SEQ ID:187, and is provided hereinbelow with reference to the sequence listing part. Nucleotide sequence SEQ ID:187 is located at position 107873 relative to the genome of Vaccinia virus.

VGAM201 precursor RNA, herein designated VGAM PRECURSOR RNA, folds onto itself, forming VGAM201 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM201 folded precursor RNA, herein designated VGAM FOLDED PRECURSOR RNA, into VGAM201 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM201 RNA is designated SEQ ID:536, and is provided hereinbelow with reference to the sequence listing part.

VGAM201 host target gene, herein designated VGAM HOST TARGET GENE, encodes a corresponding messenger RNA, VGAM201 host target RNA, herein designated VGAM HOST TARGET RNA. VGAM201 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM201 RNA, herein designated VGAM RNA, binds complementarily to one or more host target binding sites located in untranslated regions of VGAM201 host target RNA, herein designated VGAM HOST TARGET RNA. This complementary binding is due to the fact that the nucleotide sequence of VGAM201 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM201 RNA, herein designated VGAM RNA, may have a different number of host target binding sites in untranslated regions of a VGAM201 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM201 RNA, herein designated VGAM RNA, to host target binding sites on VGAM201 host target RNA, herein designated VGAM HOST TARGET RNA, such as BINDING SITE I, BINDING SITE II and BINDING SITE III, inhibits translation of VGAM201 host target RNA, herein designated VGAM HOST TARGET RNA, into VGAM201 host target protein, herein designated VGAM HOST TARGET PROTEIN. VGAM host target protein is therefore outlined by a broken line.

It is appreciated that VGAM201 host target gene, herein designated VGAM HOST TARGET GENE, in fact represents a plurality of VGAM201 host target genes. The mRNA of each one of this plurality of VGAM201 host target genes comprises one or more host target binding sites, each having a nucleotide sequence which is at least partly complementary to VGAM201 RNA, herein designated VGAM RNA, and which when bound by VGAM201 RNA, herein designated VGAM RNA, causes inhibition of translation of respective one or more VGAM201 host target proteins.

It is further appreciated by one skilled in the art that the mode of translational inhibition illustrated by FIG. 1 with specific reference to translational inhibition exerted by VGAM201 gene, herein designated VGAM GENE, on one or more VGAM201 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM201 is inhibition of expression of host target genes, as part of a novel viral mechanism of attacking a host. Accordingly, utilities of VGAM201 include diagnosis, prevention and treatment of viral infection by Vaccinia virus. Specific functions, and accordingly utilities, of VGAM201 correlate with, and may be deduced from, the identity of the host target genes which VGAM201 binds and inhibits, and the function of these host target genes, as elaborated hereinbelow.

Nucleotide sequences of the VGAM201 precursor RNA, herein designated VGAM PRECURSOR RNA, and of the diced VGAM201 RNA, herein designated VGAM RNA, and a schematic representation of the secondary folding of VGAM201 folded precursor RNA, herein designated VGAM FOLDED PRECURSOR RNA, of VGAM201 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM201 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 202 (VGAM202) viral gene, which modulates expression of respective host target genes thereof, the function and utility of which host target genes is known in the art.

VGAM202 is a novel bioinformatically detected regulatory, non protein coding, viral micro RNA (miRNA) gene.

The method by which VGAM202 was detected is described hereinabove with reference to FIGS. 2-8.

VGAM202 gene, herein designated VGAM GENE, is a viral gene contained in the genome of Vaccinia virus. VGAM202 host target gene, herein designated VGAM HOST TARGET GENE, is a human gene contained in the human genome.

VGAM202 gene, herein designated VGAM GENE, encodes a VGAM202 precursor RNA, herein designated VGAM PRECURSOR RNA. Similar to other miRNA genes, and unlike most ordinary genes, VGAM202 precursor RNA, herein designated VGAM PRECURSOR RNA, does not encode a protein. A nucleotide sequence identical or highly similar to the nucleotide sequence of VGAM202 precursor RNA is designated SEQ ID:188, and is provided hereinbelow with reference to the sequence listing part. Nucleotide sequence SEQ ID:188 is located at position 108007 relative to the genome of Vaccinia virus.

VGAM202 precursor RNA, herein designated VGAM PRECURSOR RNA, folds onto itself, forming VGAM202 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM202 folded precursor RNA, herein designated VGAM FOLDED PRECURSOR RNA, into VGAM202 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 87%) nucleotide sequence of VGAM202 RNA is designated SEQ ID:537, and is provided hereinbelow with reference to the sequence listing part.

VGAM202 host target gene, herein designated VGAM HOST TARGET GENE, encodes a corresponding messenger RNA, VGAM202 host target RNA, herein designated VGAM HOST TARGET RNA. VGAM202 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM202 RNA, herein designated VGAM RNA, binds complementarily to one or more host target binding sites located in untranslated regions of VGAM202 host target RNA, herein designated VGAM HOST TARGET RNA. This complementary binding is due to the fact that the nucleotide sequence of VGAM202 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM202 RNA, herein designated VGAM RNA, may have a different number of host target binding sites in untranslated regions of a VGAM202 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM202 RNA, herein designated VGAM RNA, to host target binding sites on VGAM202 host target RNA, herein designated VGAM HOST TARGET RNA, such as BINDING SITE I, BINDING SITE II and BINDING SITE III, inhibits translation of VGAM202 host target RNA, herein designated VGAM HOST TARGET RNA, into VGAM202 host target protein, herein designated VGAM HOST TARGET PROTEIN. VGAM host target protein is therefore outlined by a broken line.

It is appreciated that VGAM202 host target gene, herein designated VGAM HOST TARGET GENE, in fact represents a plurality of VGAM202 host target genes. The mRNA of each one of this plurality of VGAM202 host target genes comprises one or more host target binding sites, each having a nucleotide sequence which is at least partly complementary to VGAM202 RNA, herein designated VGAM RNA, and which when bound by VGAM202 RNA, herein designated VGAM RNA, causes inhibition of translation of respective one or more VGAM202 host target proteins.

It is further appreciated by one skilled in the art that the mode of translational inhibition illustrated by FIG. 1 with specific reference to translational inhibition exerted by VGAM202 gene, herein designated VGAM GENE, on one or more VGAM202 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM202 is inhibition of expression of host target genes, as part of a novel viral mechanism of attacking a host. Accordingly, utilities of VGAM202 include diagnosis, prevention and treatment of viral infection by Vaccinia virus. Specific functions, and accordingly utilities of VGAM202 correlate with, and may be deduced from, the identity of the host target genes which VGAM202 binds and inhibits, and the function of these host target genes, as elaborated hereinbelow.

Nucleotide sequences of the VGAM202 precursor RNA, herein designated VGAM PRECURSOR RNA, and of the diced VGAM202 RNA, herein designated VGAM RNA, and a schematic representation of the secondary folding of VGAM202 folded precursor RNA, herein designated VGAM FOLDED PRECURSOR RNA, of VGAM202 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM202 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 203 (VGAM203) viral gene, which modulates expression of respective host target genes thereof, the function and utility of which host target genes is known in the art.

VGAM203 is a novel bioinformatically detected regulatory, non protein coding, viral micro RNA (miRNA) gene. The method by which VGAM203 was detected is described hereinabove with reference to FIGS. 2-8.

VGAM203 gene, herein designated VGAM GENE, is a viral gene contained in the genome of Vaccinia virus. VGAM203 host target gene, herein designated VGAM HOST TARGET GENE, is a human gene contained in the human genome.

VGAM203 gene, herein designated VGAM GENE, encodes a VGAM203 precursor RNA, herein designated VGAM PRECURSOR RNA. Similar to other miRNA genes, and unlike most ordinary genes, VGAM203 precursor RNA, herein designated VGAM PRECURSOR RNA, does not encode a protein. A nucleotide sequence identical or highly similar to the nucleotide sequence of VGAM203 precursor RNA is designated SEQ ID:189, and is provided hereinbelow with reference to the sequence listing part. Nucleotide sequence SEQ ID:189 is located at position 108588 relative to the genome of Vaccinia virus.

VGAM203 precursor RNA, herein designated VGAM PRECURSOR RNA, folds onto itself, forming VGAM203 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM203 folded precursor RNA, herein designated VGAM FOLDED PRECURSOR RNA, into VGAM203 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 76%) nucleotide sequence of VGAM203 RNA is designated SEQ ID:538, and is provided hereinbelow with reference to the sequence listing part.

VGAM203 host target gene, herein designated VGAM HOST TARGET GENE, encodes a corresponding messenger RNA, VGAM203 host target RNA, herein designated VGAM HOST TARGET RNA. VGAM203 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM203 RNA, herein designated VGAM RNA, binds complementarily to one or more host target binding sites located in untranslated regions of VGAM203 host target RNA, herein designated VGAM HOST TARGET RNA. This complementary binding is due to the fact that the nucleotide sequence of VGAM203 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM203 RNA, herein designated VGAM RNA, may have a different number of host target binding sites in untranslated regions of a VGAM203 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM203 RNA, herein designated VGAM RNA, to host target binding sites on VGAM203 host target RNA, herein designated VGAM HOST TARGET RNA, such as BINDING SITE I, BINDING SITE II and BINDING SITE III, inhibits translation of VGAM203 host target RNA, herein designated VGAM HOST TARGET RNA, into VGAM203 host target protein, herein designated VGAM HOST TARGET PROTEIN. VGAM host target protein is therefore outlined by a broken line.

It is appreciated that VGAM203 host target gene, herein designated VGAM HOST TARGET GENE, in fact represents a plurality of VGAM203 host target genes. The mRNA of each one of this plurality of VGAM203 host target genes comprises one or more host target binding sites, each having a nucleotide sequence which is at least partly complementary to VGAM203 RNA, herein designated VGAM RNA, and which when bound by VGAM203 RNA, herein designated VGAM RNA, causes inhibition of translation of respective one or more VGAM203 host target proteins.

It is further appreciated by one skilled in the art that the mode of translational inhibition illustrated by FIG. 1 with specific reference to translational inhibition exerted by VGAM203 gene, herein designated VGAM GENE, on one or more VGAM203 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM203 is inhibition of expression of host target genes, as part of a novel viral mechanism of attacking a host. Accordingly, utilities of VGAM203 include diagnosis, prevention and treatment of viral infection by Vaccinia virus. Specific functions, and accordingly utilities, of VGAM203 correlate with, and may be deduced from, the identity of the host target genes which VGAM203 binds and inhibits, and the function of these host target genes, as elaborated hereinbelow.

Nucleotide sequences of the VGAM203 precursor RNA, herein designated VGAM PRECURSOR RNA, and of the diced VGAM203 RNA, herein designated VGAM RNA, and a schematic representation of the secondary folding of VGAM203 folded precursor RNA, herein designated VGAM FOLDED PRECURSOR RNA, of VGAM203 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM203 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 204 (VGAM204) viral gene, which modulates expression of respective host target genes thereof, the function and utility of which host target genes is known in the art.

VGAM204 is a novel bioinformatically detected regulatory, non protein coding, viral micro RNA (miRNA) gene. The method by which VGAM204 was detected is described hereinabove with reference to FIGS. 2-8.

VGAM204 gene, herein designated VGAM GENE, is a viral gene contained in the genome of Vaccinia virus. VGAM204 host target gene, herein designated VGAM HOST TARGET GENE, is a human gene contained in the human genome.

VGAM204 gene, herein designated VGAM GENE, encodes a VGAM204 precursor RNA, herein designated VGAM PRECURSOR RNA. Similar to other miRNA genes, and unlike most ordinary genes, VGAM204 precursor RNA, herein designated VGAM PRECURSOR RNA, does not encode a protein. A nucleotide sequence identical or highly similar to the nucleotide sequence of VGAM204 precursor RNA is designated SEQ ID:190, and is provided hereinbelow with reference to the sequence listing part. Nucleotide sequence SEQ ID:190 is located at position 108944 relative to the genome of Vaccinia virus.

VGAM204 precursor RNA, herein designated VGAM PRECURSOR RNA, folds onto itself, forming VGAM204 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM204 folded precursor RNA, herein designated VGAM FOLDED PRECURSOR RNA, into VGAM204 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 74%) nucleotide sequence of VGAM204 RNA is designated SEQ ID:539, and is provided hereinbelow with reference to the sequence listing part.

VGAM204 host target gene, herein designated VGAM HOST TARGET GENE, encodes a corresponding messenger RNA, VGAM204 host target RNA, herein designated VGAM HOST TARGET RNA. VGAM204 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM204 RNA, herein designated VGAM RNA, binds complementarily to one or more host target binding sites located in untranslated regions of VGAM204 host target RNA, herein designated VGAM HOST TARGET RNA. This complementary binding is due to the fact that the nucleotide sequence of VGAM204 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM204 RNA, herein designated VGAM RNA, may have a different number of host target binding sites in untranslated regions of a VGAM204 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM204 RNA, herein designated VGAM RNA, to host target binding sites on VGAM204 host target RNA, herein designated VGAM HOST TARGET RNA, such as BINDING SITE I, BINDING SITE II and BINDING SITE III, inhibits translation of VGAM204 host target RNA, herein designated VGAM HOST TARGET RNA, into VGAM204 host target protein, herein designated VGAM HOST TARGET PROTEIN. VGAM host target protein is therefore outlined by a broken line.

It is appreciated that VGAM204 host target gene, herein designated VGAM HOST TARGET GENE, in fact represents a plurality of VGAM204 host target genes. The mRNA of each one of this plurality of VGAM204 host target genes comprises one or more host target binding sites, each having a nucleotide sequence which is at least partly complementary to VGAM204 RNA, herein designated VGAM RNA, and which when bound by VGAM204 RNA, herein designated VGAM RNA, causes inhibition of translation of respective one or more VGAM204 host target proteins.

It is further appreciated by one skilled in the art that the mode of translational inhibition illustrated by FIG. 1 with specific reference to translational inhibition exerted by VGAM204 gene, herein designated VGAM GENE, on one or more VGAM204 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM204 is inhibition of expression of host target genes, as part of a novel viral mechanism of attacking a host. Accordingly, utilities of VGAM204 include diagnosis, prevention and treatment of viral infection by Vaccinia virus. Specific functions, and accordingly utilities, of VGAM204 correlate with, and may be deduced from, the identity of the host target genes which VGAM204 binds and inhibits, and the function of these host target genes, as elaborated hereinbelow.

Nucleotide sequences of the VGAM204 precursor RNA, herein designated VGAM PRECURSOR RNA, and of the diced VGAM204 RNA, herein designated VGAM RNA, and a schematic representation of the secondary folding of VGAM204 folded precursor RNA, herein designated VGAM FOLDED PRECURSOR RNA, of VGAM204 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM204 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 205 (VGAM205) viral gene, which modulates expression of respective host target genes thereof, the function and utility of which host target genes is known in the art.

VGAM205 is a novel bioinformatically detected regulatory, non protein coding, viral micro RNA (miRNA) gene. The method by which VGAM205 was detected is described hereinabove with reference to FIGS. 2-8.

VGAM205 gene, herein designated VGAM GENE, is a viral gene contained in the genome of Vaccinia virus. VGAM205 host target gene, herein designated VGAM HOST TARGET GENE, is a human gene contained in the human genome.

VGAM205 gene, herein designated VGAM GENE, encodes a VGAM205 precursor RNA, herein designated VGAM PRECURSOR RNA. Similar to other miRNA genes, and unlike most ordinary genes, VGAM205 precursor RNA, herein designated VGAM PRECURSOR RNA, does not encode a protein. A nucleotide sequence identical or highly similar to the nucleotide sequence of VGAM205 precursor RNA is designated SEQ ID:191, and is provided hereinbelow with reference to the sequence listing part. Nucleotide sequence SEQ ID:191 is located at position 108758 relative to the genome of Vaccinia virus.

VGAM205 precursor RNA, herein designated VGAM PRECURSOR RNA, folds onto itself, forming VGAM205 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM205 folded precursor RNA, herein designated VGAM FOLDED PRECURSOR RNA, into VGAM205 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 78%) nucleotide sequence of VGAM205 RNA is designated SEQ ID:540, and is provided hereinbelow with reference to the sequence listing part.

VGAM205 host target gene, herein designated VGAM HOST TARGET GENE, encodes a corresponding messenger RNA, VGAM205 host target RNA, herein designated VGAM HOST TARGET RNA. VGAM205 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM205 RNA, herein designated VGAM RNA, binds complementarily to one or more host target binding sites located in untranslated regions of VGAM205 host target RNA, herein designated VGAM HOST TARGET RNA. This complementary binding is due to the fact that the nucleotide sequence of VGAM205 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM205 RNA, herein designated VGAM RNA, may have a different number of host target binding sites in untranslated regions of a VGAM205 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM205 RNA, herein designated VGAM RNA, to host target binding sites on VGAM205 host target RNA, herein designated VGAM HOST TARGET RNA, such as BINDING SITE I, BINDING SITE II and BINDING SITE III, inhibits translation of VGAM205 host target RNA, herein designated VGAM HOST TARGET RNA, into VGAM205 host target protein, herein designated VGAM HOST TARGET PROTEIN. VGAM host target protein is therefore outlined by a broken line.

It is appreciated that VGAM205 host target gene, herein designated VGAM HOST TARGET GENE, in fact represents a plurality of VGAM205 host target genes. The mRNA of each one of this plurality of VGAM205 host target genes comprises one or more host target binding sites, each having a nucleotide sequence which is at least partly complementary to VGAM205 RNA, herein designated VGAM RNA, and which when bound by VGAM205 RNA, herein designated VGAM RNA, causes inhibition of translation of respective one or more VGAM205 host target proteins.

It is further appreciated by one skilled in the art that the mode of translational inhibition illustrated by FIG. 1 with specific reference to translational inhibition exerted by VGAM205 gene, herein designated VGAM GENE, on one or more VGAM205 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM205 is inhibition of expression of host target genes, as part of a novel viral mechanism of attacking a host. Accordingly, utilities of VGAM205 include diagnosis, prevention and treatment of viral infection by Vaccinia virus. Specific functions, and accordingly utilities, of VGAM205 correlate with, and may be deduced from, the identity of the host target genes which VGAM205 binds and inhibits, and the function of these host target genes, as elaborated hereinbelow.

Nucleotide sequences of the VGAM205 precursor RNA, herein designated VGAM PRECURSOR RNA, and of the diced VGAM205 RNA, herein designated VGAM RNA, and a schematic representation of the secondary folding of VGAM205 folded precursor RNA, herein designated VGAM FOLDED PRECURSOR RNA, of VGAM205 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM205 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 206 (VGAM206) viral gene, which modulates expression of respective host target genes thereof, the function and utility of which host target genes is known in the art.

VGAM206 is a novel bioinformatically detected regulatory, non protein coding, viral micro RNA (miRNA) gene. The method by which VGAM206 was detected is described hereinabove with reference to FIGS. 2-8.

VGAM206 gene, herein designated VGAM GENE, is a viral gene contained in the genome of Vaccinia virus. VGAM206 host target gene, herein designated VGAM HOST TARGET GENE, is a human gene contained in the human genome.

VGAM206 gene, herein designated VGAM GENE, encodes a VGAM206 precursor RNA, herein designated VGAM PRECURSOR RNA. Similar to other miRNA genes, and unlike most ordinary genes, VGAM206 precursor RNA, herein designated VGAM PRECURSOR RNA, does not encode a protein. A nucleotide sequence identical or highly similar to the nucleotide sequence of VGAM206 precursor RNA is designated SEQ ID:192, and is provided hereinbelow with reference to the sequence listing part. Nucleotide sequence SEQ ID:192 is located at position 109361 relative to the genome of Vaccinia virus.

VGAM206 precursor RNA, herein designated VGAM PRECURSOR RNA, folds onto itself, forming VGAM206 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM206 folded precursor RNA, herein designated VGAM FOLDED PRECURSOR RNA, into VGAM206 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 78%) nucleotide sequence of VGAM206 RNA is designated SEQ ID:541, and is provided hereinbelow with reference to the sequence listing part.

VGAM206 host target gene, herein designated VGAM HOST TARGET GENE, encodes a corresponding messenger RNA, VGAM206 host target RNA, herein designated VGAM HOST TARGET RNA. VGAM206 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM206 RNA, herein designated VGAM RNA, binds complementarily to one or more host target binding sites located in untranslated regions of VGAM206 host target RNA, herein designated VGAM HOST TARGET RNA. This complementary binding is due to the fact that the nucleotide sequence of VGAM206 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM206 RNA, herein designated VGAM RNA, may have a different number of host target binding sites in untranslated regions of a VGAM206 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM206 RNA, herein designated VGAM RNA, to host target binding sites on VGAM206 host target RNA, herein designated VGAM HOST TARGET RNA, such as BINDING SITE I, BINDING SITE II and BINDING SITE III, inhibits translation of VGAM206 host target RNA, herein designated VGAM HOST TARGET RNA, into VGAM206 host target protein, herein designated VGAM HOST TARGET PROTEIN. VGAM host target protein is therefore outlined by a broken line.

It is appreciated that VGAM206 host target gene, herein designated VGAM HOST TARGET GENE, in fact represents a plurality of VGAM206 host target genes. The mRNA of each one of this plurality of VGAM206 host target genes comprises one or more host target binding sites, each having a nucleotide sequence which is at least partly complementary to VGAM206 RNA, herein designated VGAM RNA, and which when bound by VGAM206 RNA, herein designated VGAM RNA, causes inhibition of translation of respective one or more VGAM206 host target proteins.

It is further appreciated by one skilled in the art that the mode of translational inhibition illustrated by FIG. 1 with specific reference to translational inhibition exerted by VGAM206 gene, herein designated VGAM GENE, on one or more VGAM206 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM206 is inhibition of expression of host target genes, as part of a novel viral mechanism of attacking a host. Accordingly, utilities of VGAM206 include diagnosis, prevention and treatment of viral infection by Vaccinia virus. Specific functions, and accordingly utilities, of VGAM206 correlate with, and may be deduced from, the identity of the host target genes which VGAM206 binds and inhibits, and the function of these host target genes, as elaborated hereinbelow.

Nucleotide sequences of the VGAM206 precursor RNA, herein designated VGAM PRECURSOR RNA, and of the diced VGAM206 RNA, herein designated VGAM RNA, and a schematic representation of the secondary folding of VGAM206 folded precursor RNA, herein designated VGAM FOLDED PRECURSOR RNA, of VGAM206 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM206 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 207 (VGAM207) viral gene, which modulates expression of respective host target genes thereof, the function and utility of which host target genes is known in the art.

VGAM207 is a novel bioinformatically detected regulatory, non protein coding, viral micro RNA (miRNA) gene. The method by which VGAM207 was detected is described hereinabove with reference to FIGS. 2-8.

VGAM207 gene, herein designated VGAM GENE, is a viral gene contained in the genome of Vaccinia virus. VGAM207 host target gene, herein designated VGAM HOST TARGET GENE, is a human gene contained in the human genome.

VGAM207 gene, herein designated VGAM GENE, encodes a VGAM207 precursor RNA, herein designated VGAM PRECURSOR RNA. Similar to other miRNA genes, and unlike most ordinary genes, VGAM207 precursor RNA, herein designated VGAM PRECURSOR RNA, does not encode a protein. A nucleotide sequence identical or highly similar to the nucleotide sequence of VGAM207 precursor RNA is designated SEQ ID:193, and is provided hereinbelow with reference to the sequence listing part. Nucleotide sequence SEQ ID:193 is located at position 109549 relative to the genome of Vaccinia virus.

VGAM207 precursor RNA, herein designated VGAM PRECURSOR RNA, folds onto itself, forming VGAM207 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM207 folded precursor RNA, herein designated VGAM FOLDED PRECURSOR RNA, into VGAM207 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM207 RNA is designated SEQ ID:542, and is provided hereinbelow with reference to the sequence listing part.

VGAM207 host target gene, herein designated VGAM HOST TARGET GENE, encodes a corresponding messenger RNA, VGAM207 host target RNA, herein designated VGAM HOST TARGET RNA. VGAM207 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM207 RNA, herein designated VGAM RNA, binds complementarily to one or more host target binding sites located in untranslated regions of VGAM207 host target RNA, herein designated VGAM HOST TARGET RNA. This complementary binding is due to the fact that the nucleotide sequence of VGAM207 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM207 RNA, herein designated VGAM RNA, may have a different number of host target binding sites in untranslated regions of a VGAM207 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM207 RNA, herein designated VGAM RNA, to host target binding sites on VGAM207 host target RNA, herein designated VGAM HOST TARGET RNA, such as BINDING SITE I, BINDING SITE II and BINDING SITE III, inhibits translation of VGAM207 host target RNA, herein designated VGAM HOST TARGET RNA, into VGAM207 host target protein, herein designated VGAM HOST TARGET PROTEIN. VGAM host target protein is therefore outlined by a broken line.

It is appreciated that VGAM207 host target gene, herein designated VGAM HOST TARGET GENE, in fact represents a plurality of VGAM207 host target genes. The mRNA of each one of this plurality of VGAM207 host target genes comprises one or more host target binding sites, each having a nucleotide sequence which is at least partly complementary to VGAM207 RNA, herein designated VGAM RNA, and which when bound by VGAM207 RNA, herein designated VGAM RNA, causes inhibition of translation of respective one or more VGAM207 host target proteins.

It is further appreciated by one skilled in the art that the mode of translational inhibition illustrated by FIG. 1 with specific reference to translational inhibition exerted by VGAM207 gene, herein designated VGAM GENE, on one or more VGAM207 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM207 is inhibition of expression of host target genes, as part of a novel viral mechanism of attacking a host. Accordingly, utilities of VGAM207 include diagnosis, prevention and treatment of viral infection by Vaccinia virus. Specific functions, and accordingly utilities, of VGAM207 correlate with, and may be deduced from, the identity of the host target genes which VGAM207 binds and inhibits, and the function of these host target genes, as elaborated hereinbelow.

Nucleotide sequences of the VGAM207 precursor RNA, herein designated VGAM PRECURSOR RNA, and of the diced VGAM207 RNA, herein designated VGAM RNA, and a schematic representation of the secondary folding of VGAM207 folded precursor RNA, herein designated VGAM FOLDED PRECURSOR RNA, of VGAM207 are further described hereinbelow with reference to Table 1.

Nucleotide sequences of host target binding sites, such as BINDING SITE-I, BINDING SITE-II and BINDING SITE- III of FIG. 1, found on, and schematic representation of the complementarity of each of these host target binding sites to VGAM207 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 208 (VGAM208) viral gene, which modulates expression of respective host target genes thereof, the function and utility of which host target genes is known in the art.

VGAM208 is a novel bioinformatically detected regulatory, non protein coding, viral micro RNA (miRNA) gene. The method by which VGAM208 was detected is described hereinabove with reference to FIGS. 2-8.

VGAM208 gene, herein designated VGAM GENE, is a viral gene contained in the genome of Vaccinia virus. VGAM208 host target gene, herein designated VGAM HOST TARGET GENE, is a human gene contained in the human genome.

VGAM208 gene, herein designated VGAM GENE, encodes a VGAM208 precursor RNA, herein designated VGAM PRECURSOR RNA. Similar to other miRNA genes, and unlike most ordinary genes, VGAM208 precursor RNA, herein designated VGAM PRECURSOR RNA, does not encode a protein. A nucleotide sequence identical or highly similar to the nucleotide sequence of VGAM208 precursor RNA is designated SEQ ID:194, and is provided hereinbelow with reference to the sequence listing part. Nucleotide sequence SEQ ID:194 is located at position 109656 relative to the genome of Vaccinia virus.

VGAM208 precursor RNA, herein designated VGAM PRECURSOR RNA, folds onto itself, forming VGAM208 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM208 folded precursor RNA, herein designated VGAM FOLDED PRECURSOR RNA, into VGAM208 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 85%) nucleotide sequence of VGAM208 RNA is designated SEQ ID:543, and is provided hereinbelow with reference to the sequence listing part.

VGAM208 host target gene, herein designated VGAM HOST TARGET GENE, encodes a corresponding messenger RNA, VGAM208 host target RNA, herein designated VGAM HOST TARGET RNA. VGAM208 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM208 RNA, herein designated VGAM RNA, binds complementarily to one or more host target binding sites located in untranslated regions of VGAM208 host target RNA, herein designated VGAM HOST TARGET RNA. This complementary binding is due to the fact that the nucleotide sequence of VGAM208 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM208 RNA, herein designated VGAM RNA, may have a different number of host target binding sites in untranslated regions of a VGAM208 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM208 RNA, herein designated VGAM RNA, to host target binding sites on VGAM208 host target RNA, herein designated VGAM HOST TARGET RNA, such as BINDING SITE I, BINDING SITE II and BINDING SITE III, inhibits translation of VGAM208 host target RNA, herein designated VGAM HOST TARGET RNA, into VGAM208 host target protein, herein designated VGAM HOST TARGET PROTEIN. VGAM host target protein is therefore outlined by a broken line.

It is appreciated that VGAM208 host target gene, herein designated VGAM HOST TARGET GENE, in fact represents a plurality of VGAM208 host target genes. The mRNA of each one of this plurality of VGAM208 host target genes comprises one or more host target binding sites, each having a nucleotide sequence which is at least partly complementary to VGAM208 RNA, herein designated VGAM RNA, and which when bound by VGAM208 RNA, herein designated VGAM RNA, causes inhibition of translation of respective one or more VGAM208 host target proteins.

It is further appreciated by one skilled in the art that the mode of translational inhibition illustrated by FIG. 1 with specific reference to translational inhibition exerted by VGAM208 gene, herein designated VGAM GENE, on one or more VGAM208 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM208 is inhibition of expression of host target genes, as part of a novel viral mechanism of attacking a host. Accordingly, utilities of VGAM208 include diagnosis, prevention and treatment of viral infection by Vaccinia virus. Specific functions, and accordingly utilities, of VGAM208 correlate with, and may be deduced from, the identity of the host target genes which VGAM208 binds and inhibits, and the function of these host target genes, as elaborated hereinbelow.

Nucleotide sequences of the VGAM208 precursor RNA, herein designated VGAM PRECURSOR RNA, and of the diced VGAM208 RNA, herein designated VGAM RNA, and a schematic representation of the secondary folding of VGAM208 folded precursor RNA, herein designated VGAM FOLDED PRECURSOR RNA, of VGAM208 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM208 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 209 (VGAM209) viral gene, which modulates expression of respective host target genes thereof, the function and utility of which host target genes is known in the art.

VGAM209 is a novel bioinformatically detected regulatory, non protein coding, viral micro RNA (miRNA) gene. The method by which VGAM209 was detected is described hereinabove with reference to FIGS. 2-8.

VGAM209 gene, herein designated VGAM GENE, is a viral gene contained in the genome of Vaccinia virus. VGAM209 host target gene, herein designated VGAM HOST TARGET GENE, is a human gene contained in the human genome.

VGAM209 gene, herein designated VGAM GENE, encodes a VGAM209 precursor RNA, herein designated VGAM PRECURSOR RNA. Similar to other miRNA genes, and unlike most ordinary genes, VGAM209 precursor RNA, herein designated VGAM PRECURSOR RNA, does not encode a protein. A nucleotide sequence identical or highly similar to the nucleotide sequence of VGAM209 precursor RNA is designated SEQ ID:195, and is provided hereinbelow with reference to the sequence listing part. Nucleotide sequence SEQ ID:195 is located at position 109286 relative to the genome of Vaccinia virus.

VGAM209 precursor RNA, herein designated VGAM PRECURSOR RNA, folds onto itself, forming VGAM209 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM209 folded precursor RNA, herein designated VGAM FOLDED PRECURSOR RNA, into VGAM209 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 25%) nucleotide sequence of VGAM209 RNA is designated SEQ ID:544, and is provided hereinbelow with reference to the sequence listing part.

VGAM209 host target gene, herein designated VGAM HOST TARGET GENE, encodes a corresponding messenger RNA, VGAM209 host target RNA, herein designated VGAM HOST TARGET RNA. VGAM209 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM209 RNA, herein designated VGAM RNA, binds complementarily to one or more host target binding sites located in untranslated regions of VGAM209 host target RNA, herein designated VGAM HOST TARGET RNA. This complementary binding is due to the fact that the nucleotide sequence of VGAM209 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM209 RNA, herein designated VGAM RNA, may have a different number of host target binding sites in untranslated regions of a VGAM209 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM209 RNA, herein designated VGAM RNA, to host target binding sites on VGAM209 host target RNA, herein designated VGAM HOST TARGET RNA, such as BINDING SITE I, BINDING SITE II and BINDING SITE III, inhibits translation of VGAM209 host target RNA, herein designated VGAM HOST TARGET RNA, into VGAM209 host target protein, herein designated VGAM HOST TARGET PROTEIN. VGAM host target protein is therefore outlined by a broken line.

It is appreciated that VGAM209 host target gene, herein designated VGAM HOST TARGET GENE, in fact represents a plurality of VGAM209 host target genes. The mRNA of each one of this plurality of VGAM209 host target genes comprises one or more host target binding sites, each having a nucleotide sequence which is at least partly complementary to VGAM209 RNA, herein designated VGAM RNA, and which when bound by VGAM209 RNA, herein designated VGAM RNA, causes inhibition of translation of respective one or more VGAM209 host target proteins.

It is further appreciated by one skilled in the art that the mode of translational inhibition illustrated by FIG. 1 with specific reference to translational inhibition exerted by VGAM209 gene, herein designated VGAM GENE, on one or more VGAM209 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM209 is inhibition of expression of host target genes, as part of a novel viral mechanism of attacking a host. Accordingly, utilities of VGAM209 include diagnosis, prevention and treatment of viral infection by Vaccinia virus. Specific functions, and accordingly utilities, of VGAM209 correlate with, and may be deduced from, the identity of the host target genes which VGAM209 binds and inhibits, and the function of these host target genes, as elaborated hereinbelow.

Nucleotide sequences of the VGAM209 precursor RNA, herein designated VGAM PRECURSOR RNA, and of the diced VGAM209 RNA, herein designated VGAM RNA, and a schematic representation of the secondary folding of VGAM209 folded precursor RNA, herein designated VGAM FOLDED PRECURSOR RNA, of VGAM209 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM209 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 210 (VGAM210) viral gene, which modulates expression of respective host target genes thereof, the function and utility of which host target genes is known in the art.

VGAM210 is a novel bioinformatically detected regulatory, non protein coding, viral micro RNA (miRNA) gene. The method by which VGAM210 was detected is described hereinabove with reference to FIGS. 2-8.

VGAM2110 gene, herein designated VGAM GENE, is a viral gene contained in the genome of Vaccinia virus. VGAM210 host target gene, herein designated VGAM HOST TARGET GENE, is a human gene contained in the human genome.

VGAM210 gene, herein designated VGAM GENE, encodes a VGAM210 precursor RNA, herein designated VGAM PRECURSOR RNA. Similar to other miRNA genes, and unlike most ordinary genes, VGAM210 precursor RNA, herein designated VGAM PRECURSOR RNA, does not encode a protein. A nucleotide sequence identical or highly similar to the nucleotide sequence of VGAM210 precursor RNA is designated SEQ ID:196, and is provided hereinbelow with reference to the sequence listing part. Nucleotide sequence SEQ ID:196 is located at position 110952 relative to the genome of Vaccinia virus.

VGAM210 precursor RNA, herein designated VGAM PRECURSOR RNA, folds onto itself, forming VGAM210 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM210 folded precursor RNA, herein designated VGAM FOLDED PRECURSOR RNA, into VGAM210 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 91%) nucleotide sequence of VGAM210 RNA is designated SEQ ID:545, and is provided hereinbelow with reference to the sequence listing part.

VGAM210 host target gene, herein designated VGAM HOST TARGET GENE, encodes a corresponding messenger RNA, VGAM210 host target RNA, herein designated VGAM HOST TARGET RNA. VGAM210 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM210 RNA, herein designated VGAM RNA, binds complementarily to one or more host target binding sites located in untranslated regions of VGAM210 host target RNA, herein designated VGAM HOST TARGET RNA. This complementary binding is due to the fact that the nucleotide sequence of VGAM210 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM210 RNA, herein designated VGAM RNA, may have a different number of host target binding sites in untranslated regions of a VGAM210 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM210 RNA, herein designated VGAM RNA, to host target binding sites on VGAM210 host target RNA, herein designated VGAM HOST TARGET RNA, such as BINDING SITE I, BINDING SITE II and BINDING SITE III, inhibits translation of VGAM210 host target RNA, herein designated VGAM HOST TARGET RNA, into VGAM210 host target protein, herein designated VGAM HOST TARGET PROTEIN. VGAM host target protein is therefore outlined by a broken line.

It is appreciated that VGAM210 host target gene, herein designated VGAM HOST TARGET GENE, in fact represents a plurality of VGAM210 host target genes. The mRNA of each one of this plurality of VGAM210 host target genes comprises one or more host target binding sites, each having a nucleotide sequence which is at least partly complementary to VGAM210 RNA, herein designated VGAM RNA, and which when bound by VGAM210 RNA, herein designated VGAM RNA, causes inhibition of translation of respective one or more VGAM210 host target proteins.

It is further appreciated by one skilled in the art that the mode of translational inhibition illustrated by FIG. 1 with specific reference to translational inhibition exerted by VGAM210 gene, herein designated VGAM GENE, on one or more VGAM210 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM210 is inhibition of expression of host target genes, as part of a novel viral mechanism of attacking a host. Accordingly, utilities of VGAM210 include diagnosis, prevention and treatment of viral infection by Vaccinia virus. Specific functions, and accordingly utilities, of VGAM210 correlate with, and may be deduced from, the identity of the host target genes which VGAM210 binds and inhibits, and the function of these host target genes, as elaborated hereinbelow.

Nucleotide sequences of the VGAM210 precursor RNA, herein designated VGAM PRECURSOR RNA, and of the diced VGAM210 RNA, herein designated VGAM RNA, and a schematic representation of the secondary folding of VGAM210 folded precursor RNA, herein designated VGAM FOLDED PRECURSOR RNA, of VGAM210 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM210 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 211 (VGAM211) viral gene, which modulates expression of respective host target genes thereof, the function and utility of which host target genes is known in the art.

VGAM211 is a novel bioinformatically detected regulatory, non protein coding, viral micro RNA (miRNA) gene. The method by which VGAM211 was detected is described hereinabove with reference to FIGS. 2-8.

VGAM211 gene, herein designated VGAM GENE, is a viral gene contained in the genome of Vaccinia virus. VGAM211 host target gene, herein designated VGAM HOST TARGET GENE, is a human gene contained in the human genome.

VGAM211 gene, herein designated VGAM GENE, encodes a VGAM211 precursor RNA, herein designated VGAM PRECURSOR RNA. Similar to other miRNA genes, and unlike most ordinary genes, VGAM211 precursor RNA, herein designated VGAM PRECURSOR RNA, does not encode a protein. A nucleotide sequence identical or highly similar to the nucleotide sequence of VGAM211 precursor RNA is designated SEQ ID:197, and is provided hereinbelow with reference to the sequence listing part. Nucleotide sequence SEQ ID:197 is located at position 110025 relative to the genome of Vaccinia virus.

VGAM211 precursor RNA, herein designated VGAM PRECURSOR RNA, folds onto itself, forming VGAM211 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM211 folded precursor RNA, herein designated VGAM FOLDED PRECURSOR RNA, into VGAM211 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 79%) nucleotide sequence of VGAM211 RNA is designated SEQ ID:546, and is provided hereinbelow with reference to the sequence listing part.

VGAM211 host target gene, herein designated VGAM HOST TARGET GENE, encodes a corresponding messenger RNA, VGAM211 host target RNA, herein designated VGAM HOST TARGET RNA. VGAM211 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM211 RNA, herein designated VGAM RNA, binds complementarily to one or more host target binding sites located in untranslated regions of VGAM211 host target RNA, herein designated VGAM HOST TARGET RNA. This complementary binding is due to the fact that the nucleotide sequence of VGAM211 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM211 RNA, herein designated VGAM RNA, may have a different number of host target binding sites in untranslated regions of a VGAM211 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM211 RNA, herein designated VGAM RNA, to host target binding sites on VGAM211 host target RNA, herein designated VGAM HOST TARGET RNA, such as BINDING SITE I, BINDING SITE II and BINDING SITE III, inhibits translation of VGAM211 host target RNA, herein designated VGAM HOST TARGET RNA, into VGAM211 host target protein, herein designated VGAM HOST TARGET PROTEIN. VGAM host target protein is therefore outlined by a broken line.

It is appreciated that VGAM211 host target gene, herein designated VGAM HOST TARGET GENE, in fact represents a plurality of VGAM211 host target genes. The mRNA of each one of this plurality of VGAM211 host target genes comprises one or more host target binding sites, each having a nucleotide sequence which is at least partly complementary to VGAM211 RNA, herein designated VGAM RNA, and which when bound by VGAM211 RNA, herein designated VGAM RNA, causes inhibition of translation of respective one or more VGAM211 host target proteins.

It is further appreciated by one skilled in the art that the mode of translational inhibition illustrated by FIG. 1 with specific reference to translational inhibition exerted by VGAM211 gene, herein designated VGAM GENE, on one or more VGAM211 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM211 is inhibition of expression of host target genes, as part of a novel viral mechanism of attacking a host. Accordingly, utilities of VGAM211 include diagnosis, prevention and treatment of viral infection by Vaccinia virus. Specific functions, and accordingly utilities, of VGAM211 correlate with, and may be deduced from, the identity of the host target genes which VGAM211 binds and inhibits, and the function of these host target genes, as elaborated hereinbelow.

Nucleotide sequences of the VGAM211 precursor RNA, herein designated VGAM PRECURSOR RNA, and of the diced VGAM211 RNA, herein designated VGAM RNA, and a schematic representation of the secondary folding of VGAM211 folded precursor RNA, herein designated VGAM FOLDED PRECURSOR RNA, of VGAM211 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM211 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 212 (VGAM212) viral gene, which modulates expression of respective host target genes thereof, the function and utility of which host target genes is known in the art.

VGAM212 is a novel bioinformatically detected regulatory, non protein coding, viral micro RNA (miRNA) gene. The method by which VGAM212 was detected is described hereinabove with reference to FIGS. 2-8.

VGAM212 gene, herein designated VGAM GENE, is a viral gene contained in the genome of Vaccinia virus. VGAM212 host target gene, herein designated VGAM HOST TARGET GENE, is a human gene contained in the human genome.

VGAM212 gene, herein designated VGAM GENE, encodes a VGAM212 precursor RNA, herein designated VGAM PRECURSOR RNA. Similar to other miRNA genes, and unlike most ordinary genes, VGAM212 precursor RNA, herein designated VGAM PRECURSOR RNA, does not encode a protein. A nucleotide sequence identical or highly similar to the nucleotide sequence of VGAM212 precursor RNA is designated SEQ ID:198, and is provided hereinbelow with reference to the sequence listing part. Nucleotide sequence SEQ ID:198 is located at position 111922 relative to the genome of Vaccinia virus.

VGAM212 precursor RNA, herein designated VGAM PRECURSOR RNA, folds onto itself, forming VGAM212 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM212 folded precursor RNA, herein designated VGAM FOLDED PRECURSOR RNA, into VGAM212 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 76%) nucleotide sequence of VGAM212 RNA is designated SEQ ID:547, and is provided hereinbelow with reference to the sequence listing part.

VGAM212 host target gene, herein designated VGAM HOST TARGET GENE, encodes a corresponding messenger RNA, VGAM212 host target RNA, herein designated VGAM HOST TARGET RNA. VGAM212 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM212 RNA, herein designated VGAM RNA, binds complementarily to one or more host target binding sites located in untranslated regions of VGAM212 host target RNA, herein designated VGAM HOST TARGET RNA. This complementary binding is due to the fact that the nucleotide sequence of VGAM212 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM212 RNA, herein designated VGAM RNA, may have a different number of host target binding sites in untranslated regions of a VGAM212 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM212 RNA, herein designated VGAM RNA, to host target binding sites on VGAM212 host target RNA, herein designated VGAM HOST TARGET RNA, such as BINDING SITE I, BINDING SITE II and BINDING SITE III, inhibits translation of VGAM212 host target RNA, herein designated VGAM HOST TARGET RNA, into VGAM212 host target protein, herein designated VGAM HOST TARGET PROTEIN. VGAM host target protein is therefore outlined by a broken line.

It is appreciated that VGAM212 host target gene, herein designated VGAM HOST TARGET GENE, in fact represents a plurality of VGAM212 host target genes. The mRNA of each one of this plurality of VGAM212 host target genes comprises one or more host target binding sites, each having a nucleotide sequence which is at least partly complementary to VGAM212 RNA, herein designated VGAM RNA, and which when bound by VGAM212 RNA, herein designated VGAM RNA, causes inhibition of translation of respective one or more VGAM212 host target proteins.

It is further appreciated by one skilled in the art that the mode of translational inhibition illustrated by FIG. 1 with specific reference to translational inhibition exerted by VGAM212 gene, herein designated VGAM GENE, on one or more VGAM212 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM212 is inhibition of expression of host target genes, as part of a novel viral mechanism of attacking a host. Accordingly, utilities of VGAM212 include diagnosis, prevention and treatment of viral infection by Vaccinia virus. Specific functions, and accordingly utilities, of VGAM212 correlate with, and may be deduced from, the identity of the host target genes which VGAM212 binds and inhibits, and the function of these host target genes, as elaborated hereinbelow.

Nucleotide sequences of the VGAM212 precursor RNA, herein designated VGAM PRECURSOR RNA, and of the diced VGAM212 RNA, herein designated VGAM RNA, and a schematic representation of the secondary folding of VGAM212 folded precursor RNA, herein designated VGAM FOLDED PRECURSOR RNA, of VGAM212 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM212 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 213 (VGAM213) viral gene, which modulates expression of respective host target genes thereof, the function and utility of which host target genes is known in the art.

VGAM213 is a novel bioinformatically detected regulatory, non protein coding, viral micro RNA (miRNA) gene. The method by which VGAM213 was detected is described hereinabove with reference to FIGS. 2-8.

VGAM213 gene, herein designated VGAM GENE, is a viral gene contained in the genome of Vaccinia virus. VGAM213 host target gene, herein designated VGAM HOST TARGET GENE, is a human gene contained in the human genome.

VGAM213 gene, herein designated VGAM GENE, encodes a VGAM213 precursor RNA, herein designated VGAM PRECURSOR RNA. Similar to other miRNA genes, and unlike most ordinary genes, VGAM213 precursor RNA, herein designated VGAM PRECURSOR RNA, does not encode a protein. A nucleotide sequence identical or highly similar to the nucleotide sequence of VGAM213 precursor RNA is designated SEQ ID:199, and is provided hereinbelow with reference to the sequence listing part. Nucleotide sequence SEQ ID:199 is located at position 112175 relative to the genome of Vaccinia virus.

VGAM213 precursor RNA, herein designated VGAM PRECURSOR RNA, folds onto itself, forming VGAM213 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM213 folded precursor RNA, herein designated VGAM FOLDED PRECURSOR RNA, into VGAM213 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM213 RNA is designated SEQ ID:548, and is provided hereinbelow with reference to the sequence listing part.

VGAM213 host target gene, herein designated VGAM HOST TARGET GENE, encodes a corresponding messenger RNA, VGAM213 host target RNA, herein designated VGAM HOST TARGET RNA. VGAM213 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM213 RNA, herein designated VGAM RNA, binds complementarily to one or more host target binding sites located in untranslated regions of VGAM213 host target RNA, herein designated VGAM HOST TARGET RNA. This complementary binding is due to the fact that the nucleotide sequence of VGAM213 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM213 RNA, herein designated VGAM RNA, may have a different number of host target binding sites in untranslated regions of a VGAM213 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM213 RNA, herein designated VGAM RNA, to host target binding sites on VGAM213 host target RNA, herein designated VGAM HOST TARGET RNA, such as BINDING SITE I, BINDING SITE II and BINDING SITE III, inhibits translation of VGAM213 host target RNA, herein designated VGAM HOST TARGET RNA, into VGAM213 host target protein, herein designated VGAM HOST TARGET PROTEIN. VGAM host target protein is therefore outlined by a broken line.

It is appreciated that VGAM213 host target gene, herein designated VGAM HOST TARGET GENE, in fact represents a plurality of VGAM213 host target genes. The mRNA of each one of this plurality of VGAM213 host target genes comprises one or more host target binding sites, each having a nucleotide sequence which is at least partly complementary to VGAM213 RNA, herein designated VGAM RNA, and which when bound by VGAM213 RNA, herein designated VGAM RNA, causes inhibition of translation of respective one or more VGAM213 host target proteins.

It is further appreciated by one skilled in the art that the mode of translational inhibition illustrated by FIG. 1 with specific reference to translational inhibition exerted by VGAM213 gene, herein designated VGAM GENE, on one or more VGAM213 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM213 is inhibition of expression of host target genes, as part of a novel viral mechanism of attacking a host. Accordingly, utilities of VGAM213 include diagnosis, prevention and treatment of viral infection by Vaccinia virus. Specific functions, and accordingly utilities, of VGAM213 correlate with, and may be deduced from, the identity of the host target genes which VGAM213 binds and inhibits, and the function of these host target genes, as elaborated hereinbelow.

Nucleotide sequences of the VGAM213 precursor RNA, herein designated VGAM PRECURSOR RNA, and of the diced VGAM213 RNA, herein designated VGAM RNA, and a schematic representation of the secondary folding of VGAM213 folded precursor RNA, herein designated VGAM FOLDED PRECURSOR RNA, of VGAM213 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM213 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 214 (VGAM214) viral gene, which modulates expression of respective host target genes thereof, the function and utility of which host target genes is known in the art.

VGAM214 is a novel bioinformatically detected regulatory, non protein coding, viral micro RNA (miRNA) gene. The method by which VGAM214 was detected is described hereinabove with reference to FIGS. 2-8.

VGAM214 gene, herein designated VGAM GENE, is a viral gene contained in the genome of Vaccinia virus. VGAM214 host target gene, herein designated VGAM HOST TARGET GENE, is a human gene contained in the human genome.

VGAM214 gene, herein designated VGAM GENE, encodes a VGAM214 precursor RNA, herein designated VGAM PRECURSOR RNA. Similar to other miRNA genes, and unlike most ordinary genes, VGAM214 precursor RNA, herein designated VGAM PRECURSOR RNA, does not encode a protein. A nucleotide sequence identical or highly similar to the nucleotide sequence of VGAM214 precursor RNA is designated SEQ ID:200, and is provided hereinbelow with reference to the sequence listing part. Nucleotide sequence SEQ ID:200 is located at position 114150 relative to the genome of Vaccinia virus.

VGAM214 precursor RNA, herein designated VGAM PRECURSOR RNA, folds onto itself, forming VGAM214 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM214 folded precursor RNA, herein designated VGAM FOLDED PRECURSOR RNA, into VGAM214 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM214 RNA is designated SEQ ID:549, and is provided hereinbelow with reference to the sequence listing part.

VGAM214 host target gene, herein designated VGAM HOST TARGET GENE, encodes a corresponding messenger RNA, VGAM214 host target RNA, herein designated VGAM HOST TARGET RNA. VGAM214 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM214 RNA, herein designated VGAM RNA, binds complementarily to one or more host target binding sites located in untranslated regions of VGAM214 host target RNA, herein designated VGAM HOST TARGET RNA. This complementary binding is due to the fact that the nucleotide sequence of VGAM214 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM214 RNA, herein designated VGAM RNA, may have a different number of host target binding sites in untranslated regions of a VGAM214 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM214 RNA, herein designated VGAM RNA, to host target binding sites on VGAM214 host target RNA, herein designated VGAM HOST TARGET RNA, such as BINDING SITE I, BINDING SITE II and BINDING SITE III, inhibits translation of VGAM214 host target RNA, herein designated VGAM HOST TARGET RNA, into VGAM214 host target protein, herein designated VGAM HOST TARGET PROTEIN. VGAM host target protein is therefore outlined by a broken line.

It is appreciated that VGAM214 host target gene, herein designated VGAM HOST TARGET GENE, in fact represents a plurality of VGAM214 host target genes. The mRNA of each one of this plurality of VGAM214 host target genes comprises one or more host target binding sites, each having a nucleotide sequence which is at least partly complementary to VGAM214 RNA, herein designated VGAM RNA, and which when bound by VGAM214 RNA, herein designated VGAM RNA, causes inhibition of translation of respective one or more VGAM214 host target proteins.

It is further appreciated by one skilled in the art that the mode of translational inhibition illustrated by FIG. 1 with specific reference to translational inhibition exerted by VGAM214 gene, herein designated VGAM GENE, on one or more VGAM214 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM214 is inhibition of expression of host target genes, as part of a novel viral mechanism of attacking a host. Accordingly, utilities of VGAM214 include diagnosis, prevention and treatment of viral infection by Vaccinia virus. Specific functions, and accordingly utilities, of VGAM214 correlate with, and may be deduced from, the identity of the host target genes which VGAM214 binds and inhibits, and the function of these host target genes, as elaborated hereinbelow.

Nucleotide sequences of the VGAM214 precursor RNA, herein designated VGAM PRECURSOR RNA, and of the diced VGAM214 RNA, herein designated VGAM RNA, and a schematic representation of the secondary folding of VGAM214 folded precursor RNA, herein designated VGAM FOLDED PRECURSOR RNA, of VGAM214 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM214 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 215 (VGAM215) viral gene, which modulates expression of respective host target genes thereof, the function and utility of which host target genes is known in the art.

VGAM215 is a novel bioinformatically detected regulatory, non protein coding, viral micro RNA (miRNA) gene. The method by which VGAM215 was detected is described hereinabove with reference to FIGS. 2-8.

VGAM215 gene, herein designated VGAM GENE, is a viral gene contained in the genome of Vaccinia virus. VGAM215 host target gene, herein designated VGAM HOST TARGET GENE, is a human gene contained in the human genome.

VGAM215 gene, herein designated VGAM GENE, encodes a VGAM215 precursor RNA, herein designated VGAM PRECURSOR RNA. Similar to other miRNA genes, and unlike most ordinary genes, VGAM215 precursor RNA, herein designated VGAM PRECURSOR RNA, does not encode a protein. A nucleotide sequence identical or highly similar to the nucleotide sequence of VGAM215 precursor RNA is designated SEQ ID:201, and is provided hereinbelow with reference to the sequence listing part. Nucleotide sequence SEQ ID:201 is located at position 113419 relative to the genome of Vaccinia virus.

VGAM215 precursor RNA, herein designated VGAM PRECURSOR RNA, folds onto itself, forming VGAM215 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM215 folded precursor RNA, herein designated VGAM FOLDED PRECURSOR RNA, into VGAM215 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM215 RNA is designated SEQ ID:550, and is provided hereinbelow with reference to the sequence listing part.

VGAM215 host target gene, herein designated VGAM HOST TARGET GENE, encodes a corresponding messenger RNA, VGAM215 host target RNA, herein designated VGAM HOST TARGET RNA. VGAM215 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM215 RNA, herein designated VGAM RNA, binds complementarily to one or more host target binding sites located in untranslated regions of VGAM215 host target RNA, herein designated VGAM HOST TARGET RNA. This complementary binding is due to the fact that the nucleotide sequence of VGAM215 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM215 RNA, herein designated VGAM RNA, may have a different number of host target binding sites in untranslated regions of a VGAM215 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM215 RNA, herein designated VGAM RNA, to host target binding sites on VGAM215 host target RNA, herein designated VGAM HOST TARGET RNA, such as BINDING SITE I, BINDING SITE II and BINDING SITE III, inhibits translation of VGAM215 host target RNA, herein designated VGAM HOST TARGET RNA, into VGAM215 host target protein, herein designated VGAM HOST TARGET PROTEIN. VGAM host target protein is therefore outlined by a broken line.

It is appreciated that VGAM215 host target gene, herein designated VGAM HOST TARGET GENE, in fact represents a plurality of VGAM215 host target genes. The mRNA of each one of this plurality of VGAM215 host target genes comprises one or more host target binding sites, each having a nucleotide sequence which is at least partly complementary to VGAM215 RNA, herein designated VGAM RNA, and which when bound by VGAM215 RNA, herein designated VGAM RNA, causes inhibition of translation of respective one or more VGAM215 host target proteins.

It is further appreciated by one skilled in the art that the mode of translational inhibition illustrated by FIG. 1 with specific reference to translational inhibition exerted by VGAM215 gene, herein designated VGAM GENE, on one or more VGAM215 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM215 is inhibition of expression of host target genes, as part of a novel viral mechanism of attacking a host. Accordingly, utilities of VGAM215 include diagnosis, prevention and treatment of viral infection by Vaccinia virus. Specific functions, and accordingly utilities, of VGAM215 correlate with, and may be deduced from, the identity of the host target genes which VGAM215 binds and inhibits, and the function of these host target genes, as elaborated hereinbelow.

Nucleotide sequences of the VGAM215 precursor RNA, herein designated VGAM PRECURSOR RNA, and of the diced VGAM215 RNA, herein designated VGAM RNA, and a schematic representation of the secondary folding of VGAM215 folded precursor RNA, herein designated VGAM FOLDED PRECURSOR RNA, of VGAM215 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM215 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 216 (VGAM216) viral gene, which modulates expression of respective host target genes thereof, the function and utility of which host target genes is known in the art.

VGAM216 is a novel bioinformatically detected regulatory, non protein coding, viral micro RNA (miRNA) gene. The method by which VGAM216 was detected is described hereinabove with reference to FIGS. 2-8.

VGAM216 gene, herein designated VGAM GENE, is a viral gene contained in the genome of Vaccinia virus. VGAM216 host target gene, herein designated VGAM HOST TARGET GENE, is a human gene contained in the human genome.

VGAM216 gene, herein designated VGAM GENE, encodes a VGAM216 precursor RNA, herein designated VGAM PRECURSOR RNA. Similar to other miRNA genes, and unlike most ordinary genes, VGAM216 precursor RNA, herein designated VGAM PRECURSOR RNA, does not encode a protein. A nucleotide sequence identical or highly similar to the nucleotide sequence of VGAM216 precursor RNA is designated SEQ ID:202, and is provided hereinbelow with reference to the sequence listing part. Nucleotide sequence SEQ ID:202 is located at position 112722 relative to the genome of Vaccinia virus.

VGAM216 precursor RNA, herein designated VGAM PRECURSOR RNA, folds onto itself, forming VGAM216 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM216 folded precursor RNA, herein designated VGAM FOLDED PRECURSOR RNA, into VGAM216 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM216 RNA is designated SEQ ID:551, and is provided hereinbelow with reference to the sequence listing part.

VGAM216 host target gene, herein designated VGAM HOST TARGET GENE, encodes a corresponding messenger RNA, VGAM216 host target RNA, herein designated VGAM HOST TARGET RNA. VGAM216 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM216 RNA, herein designated VGAM RNA, binds complementarily to one or more host target binding sites located in untranslated regions of VGAM216 host target RNA, herein designated VGAM HOST TARGET RNA. This complementary binding is due to the fact that the nucleotide sequence of VGAM216 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM216 RNA, herein designated VGAM RNA, may have a different number of host target binding sites in untranslated regions of a VGAM216 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM216 RNA, herein designated VGAM RNA, to host target binding sites on VGAM216 host target RNA, herein designated VGAM HOST TARGET RNA, such as BINDING SITE I, BINDING SITE II and BINDING SITE III, inhibits translation of VGAM216 host target RNA, herein designated VGAM HOST TARGET RNA, into VGAM216 host target protein, herein designated VGAM HOST TARGET PROTEIN. VGAM host target protein is therefore outlined by a broken line.

It is appreciated that VGAM216 host target gene, herein designated VGAM HOST TARGET GENE, in fact represents a plurality of VGAM216 host target genes. The mRNA of each one of this plurality of VGAM216 host target genes comprises one or more host target binding sites, each having a nucleotide sequence which is at least partly complementary to VGAM216 RNA, herein designated VGAM RNA, and which when bound by VGAM216 RNA, herein designated VGAM RNA, causes inhibition of translation of respective one or more VGAM216 host target proteins.

It is further appreciated by one skilled in the art that the mode of translational inhibition illustrated by FIG. 1 with specific reference to translational inhibition exerted by VGAM216 gene, herein designated VGAM GENE, on one or more VGAM216 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM216 is inhibition of expression of host target genes, as part of a novel viral mechanism of attacking a host. Accordingly, utilities of VGAM216 include diagnosis, prevention and treatment of viral infection by Vaccinia virus. Specific functions, and accordingly utilities, of VGAM216 correlate with, and may be deduced from, the identity of the host target genes which VGAM216 binds and inhibits, and the function of these host target genes, as elaborated hereinbelow.

Nucleotide sequences of the VGAM216 precursor RNA, herein designated VGAM PRECURSOR RNA, and of the diced VGAM216 RNA, herein designated VGAM RNA, and a schematic representation of the secondary folding of VGAM216 folded precursor RNA, herein designated VGAM FOLDED PRECURSOR RNA, of VGAM216 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM216 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 217 (VGAM217) viral gene, which modulates expression of respective host target genes thereof, the function and utility of which host target genes is known in the art.

VGAM217 is a novel bioinformatically detected regulatory, non protein coding, viral micro RNA (miRNA) gene. The method by which VGAM217 was detected is described hereinabove with reference to FIGS. 2-8.

VGAM217 gene, herein designated VGAM GENE, is a viral gene contained in the genome of Vaccinia virus. VGAM217 host target gene, herein designated VGAM HOST TARGET GENE, is a human gene contained in the human genome.

VGAM217 gene, herein designated VGAM GENE, encodes a VGAM217 precursor RNA, herein designated VGAM PRECURSOR RNA. Similar to other miRNA genes, and unlike most ordinary genes, VGAM217 precursor RNA, herein designated VGAM PRECURSOR RNA, does not encode a protein. A nucleotide sequence identical or highly similar to the nucleotide sequence of VGAM217 precursor RNA is designated SEQ ID:203, and is provided hereinbelow with reference to the sequence listing part. Nucleotide sequence SEQ ID:203 is located at position 113751 relative to the genome of Vaccinia virus.

VGAM217 precursor RNA, herein designated VGAM PRECURSOR RNA, folds onto itself, forming VGAM217 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM217 folded precursor RNA, herein designated VGAM FOLDED PRECURSOR RNA, into VGAM217 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 86%) nucleotide sequence of VGAM217 RNA is designated SEQ ID:552, and is provided hereinbelow with reference to the sequence listing part.

VGAM217 host target gene, herein designated VGAM HOST TARGET GENE, encodes a corresponding messenger RNA, VGAM217 host target RNA, herein designated VGAM HOST TARGET RNA. VGAM217 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM217 RNA, herein designated VGAM RNA, binds complementarily to one or more host target binding sites located in untranslated regions of VGAM217 host target RNA, herein designated VGAM HOST TARGET RNA. This complementary binding is due to the fact that the nucleotide sequence of VGAM217 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM217 RNA, herein designated VGAM RNA, may have a different number of host target binding sites in untranslated regions of a VGAM217 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM217 RNA, herein designated VGAM RNA, to host target binding sites on VGAM217 host target RNA, herein designated VGAM HOST TARGET RNA, such as BINDING SITE I, BINDING SITE II and BINDING SITE III, inhibits translation of VGAM217 host target RNA, herein designated VGAM HOST TARGET RNA, into VGAM217 host target protein, herein designated VGAM HOST TARGET PROTEIN. VGAM host target protein is therefore outlined by a broken line.

It is appreciated that VGAM217 host target gene, herein designated VGAM HOST TARGET GENE, in fact represents a plurality of VGAM217 host target genes. The mRNA of each one of this plurality of VGAM217 host target genes comprises one or more host target binding sites, each having a nucleotide sequence which is at least partly complementary to VGAM217 RNA, herein designated VGAM RNA, and which when bound by VGAM217 RNA, herein designated VGAM RNA, causes inhibition of translation of respective one or more VGAM217 host target proteins.

It is further appreciated by one skilled in the art that the mode of translational inhibition illustrated by FIG. 1 with specific reference to translational inhibition exerted by VGAM217 gene, herein designated VGAM GENE, on one or more VGAM217 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM217 is inhibition of expression of host target genes, as part of a novel viral mechanism of attacking a host. Accordingly, utilities of VGAM217 include diagnosis, prevention and treatment of viral infection by Vaccinia virus. Specific functions, and accordingly utilities, of VGAM217 correlate with, and may be deduced from, the identity of the host target genes which VGAM217 binds and inhibits, and the function of these host target genes, as elaborated hereinbelow.

Nucleotide sequences of the VGAM217 precursor RNA, herein designated VGAM PRECURSOR RNA, and of the diced VGAM217 RNA, herein designated VGAM RNA, and a schematic representation of the secondary folding of VGAM217 folded precursor RNA, herein designated VGAM FOLDED PRECURSOR RNA, of VGAM217 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM217 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 218 (VGAM218) viral gene, which modulates expression of respective host target genes thereof, the function and utility of which host target genes is known in the art.

VGAM218 is a novel bioinformatically detected regulatory, non protein coding, viral micro RNA (miRNA) gene. The method by which VGAM218 was detected is described hereinabove with reference to FIGS. 2-8.

VGAM218 gene, herein designated VGAM GENE, is a viral gene contained in the genome of Vaccinia virus. VGAM218 host target gene, herein designated VGAM HOST TARGET GENE, is a human gene contained in the human genome.

VGAM218 gene, herein designated VGAM GENE, encodes a VGAM218 precursor RNA, herein designated VGAM PRECURSOR RNA. Similar to other miRNA genes, and unlike most ordinary genes, VGAM218 precursor RNA, herein designated VGAM PRECURSOR RNA, does not encode a protein. A nucleotide sequence identical or highly similar to the nucleotide sequence of VGAM218 precursor RNA is designated SEQ ID:204, and is provided hereinbelow with reference to the sequence listing part. Nucleotide sequence SEQ ID:204 is located at position 114325 relative to the genome of Vaccinia virus.

VGAM218 precursor RNA, herein designated VGAM PRECURSOR RNA, folds onto itself, forming VGAM218 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM218 folded precursor RNA, herein designated VGAM FOLDED PRECURSOR RNA, into VGAM218 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM218 RNA is designated SEQ ID:553, and is provided hereinbelow with reference to the sequence listing part.

VGAM218 host target gene, herein designated VGAM HOST TARGET GENE, encodes a corresponding messenger RNA, VGAM218 host target RNA, herein designated VGAM HOST TARGET RNA. VGAM218 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM218 RNA, herein designated VGAM RNA, binds complementarily to one or more host target binding sites located in untranslated regions of VGAM218 host target RNA, herein designated VGAM HOST TARGET RNA. This complementary binding is due to the fact that the nucleotide sequence of VGAM218 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM218 RNA, herein designated VGAM RNA, may have a different number of host target binding sites in untranslated regions of a VGAM218 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM218 RNA, herein designated VGAM RNA, to host target binding sites on VGAM218 host target RNA, herein designated VGAM HOST TARGET RNA, such as BINDING SITE I, BINDING SITE II and BINDING SITE III, inhibits translation of VGAM218 host target RNA, herein designated VGAM HOST TARGET RNA, into VGAM218 host target protein, herein designated VGAM HOST TARGET PROTEIN. VGAM host target protein is therefore outlined by a broken line.

It is appreciated that VGAM218 host target gene, herein designated VGAM HOST TARGET GENE, in fact represents a plurality of VGAM218 host target genes. The mRNA of each one of this plurality of VGAM218 host target genes comprises one or more host target binding sites, each having a nucleotide sequence which is at least partly complementary to VGAM218 RNA, herein designated VGAM RNA, and which when bound by VGAM218 RNA, herein designated VGAM RNA, causes inhibition of translation of respective one or more VGAM218 host target proteins.

It is further appreciated by one skilled in the art that the mode of translational inhibition illustrated by FIG. 1 with specific reference to translational inhibition exerted by VGAM218 gene, herein designated VGAM GENE, on one or more VGAM218 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM218 is inhibition of expression of host target genes, as part of a novel viral mechanism of attacking a host. Accordingly, utilities of VGAM218 include diagnosis, prevention and treatment of viral infection by Vaccinia virus. Specific functions, and accordingly utilities, of VGAM218 correlate with, and may be deduced from, the identity of the host target genes which VGAM218 binds and inhibits, and the function of these host target genes, as elaborated hereinbelow.

Nucleotide sequences of the VGAM218 precursor RNA, herein designated VGAM PRECURSOR RNA, and of the diced VGAM218 RNA, herein designated VGAM RNA, and a schematic representation of the secondary folding of VGAM218 folded precursor RNA, herein designated VGAM FOLDED PRECURSOR RNA, of VGAM218 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM218 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 219 (VGAM219) viral gene, which modulates expression of respective host target genes thereof, the function and utility of which host target genes is known in the art.

VGAM219 is a novel bioinformatically detected regulatory, non protein coding, viral micro RNA (miRNA) gene. The method by which VGAM219 was detected is described hereinabove with reference to FIGS. 2-8.

VGAM219 gene, herein designated VGAM GENE, is a viral gene contained in the genome of Vaccinia virus. VGAM219 host target gene, herein designated VGAM HOST TARGET GENE, is a human gene contained in the human genome.

VGAM219 gene, herein designated VGAM GENE, encodes a VGAM219 precursor RNA, herein designated VGAM PRECURSOR RNA. Similar to other miRNA genes, and unlike most ordinary genes, VGAM219 precursor RNA, herein designated VGAM PRECURSOR RNA, does not encode a protein. A nucleotide sequence identical or highly similar to the nucleotide sequence of VGAM219 precursor RNA is designated SEQ ID:205, and is provided hereinbelow with reference to the sequence listing part. Nucleotide sequence SEQ ID:205 is located at position 115962 relative to the genome of Vaccinia virus.

VGAM219 precursor RNA, herein designated VGAM PRECURSOR RNA, folds onto itself, forming VGAM219 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM219 folded precursor RNA, herein designated VGAM FOLDED PRECURSOR RNA, into VGAM219 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM219 RNA is designated SEQ ID:554, and is provided hereinbelow with reference to the sequence listing part.

VGAM219 host target gene, herein designated VGAM HOST TARGET GENE, encodes a corresponding messenger RNA, VGAM219 host target RNA, herein designated VGAM HOST TARGET RNA. VGAM219 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM219 RNA, herein designated VGAM RNA, binds complementarily to one or more host target binding sites located in untranslated regions of VGAM219 host target RNA, herein designated VGAM HOST TARGET RNA. This complementary binding is due to the fact that the nucleotide sequence of VGAM219 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM219 RNA, herein designated VGAM RNA, may have a different number of host target binding sites in untranslated regions of a VGAM219 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM219 RNA, herein designated VGAM RNA, to host target binding sites on VGAM219 host target RNA, herein designated VGAM HOST TARGET RNA, such as BINDING SITE I, BINDING SITE II and BINDING SITE III, inhibits translation of VGAM219 host target RNA, herein designated VGAM HOST TARGET RNA, into VGAM219 host target protein, herein designated VGAM HOST TARGET PROTEIN. VGAM host target protein is therefore outlined by a broken line.

It is appreciated that VGAM219 host target gene, herein designated VGAM HOST TARGET GENE, in fact represents a plurality of VGAM219 host target genes. The mRNA of each one of this plurality of VGAM219 host target genes comprises one or more host target binding sites, each having a nucleotide sequence which is at least partly complementary to VGAM219 RNA, herein designated VGAM RNA, and which when bound by VGAM219 RNA, herein designated VGAM RNA, causes inhibition of translation of respective one or more VGAM219 host target proteins.

It is further appreciated by one skilled in the art that the mode of translational inhibition illustrated by FIG. 1 with specific reference to translational inhibition exerted by VGAM219 gene, herein designated VGAM GENE, on one or more VGAM219 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM219 is inhibition of expression of host target genes, as part of a novel viral mechanism of attacking a host. Accordingly, utilities of VGAM219 include diagnosis, prevention and treatment of viral infection by Vaccinia virus. Specific functions, and accordingly utilities, of VGAM219 correlate with, and may be deduced from, the identity of the host target genes which VGAM219 binds and inhibits, and the function of these host target genes, as elaborated hereinbelow.

Nucleotide sequences of the VGAM219 precursor RNA, herein designated VGAM PRECURSOR RNA, and of the diced VGAM219 RNA, herein designated VGAM RNA, and a schematic representation of the secondary folding of VGAM219 folded precursor RNA, herein designated VGAM FOLDED PRECURSOR RNA, of VGAM219 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM219 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 220 (VGAM220) viral gene, which modulates expression of respective host target genes thereof, the function and utility of which host target genes is known in the art.

VGAM220 is a novel bioinformatically detected regulatory, non protein coding, viral micro RNA (miRNA) gene. The method by which VGAM220 was detected is described hereinabove with reference to FIGS. 2-8.

VGAM220 gene, herein designated VGAM GENE, is a viral gene contained in the genome of Vaccinia virus. VGAM220 host target gene, herein designated VGAM HOST TARGET GENE, is a human gene contained in the human genome.

VGAM220 gene, herein designated VGAM GENE, encodes a VGAM220 precursor RNA, herein designated VGAM PRECURSOR RNA. Similar to other miRNA genes, and unlike most ordinary genes, VGAM220 precursor RNA, herein designated VGAM PRECURSOR RNA, does not encode a protein. A nucleotide sequence identical or highly similar to the nucleotide sequence of VGAM220 precursor RNA is designated SEQ ID:206, and is provided hereinbelow with reference to the sequence listing part. Nucleotide sequence SEQ ID:206 is located at position 115869 relative to the genome of Vaccinia virus.

VGAM220 precursor RNA, herein designated VGAM PRECURSOR RNA, folds onto itself, forming VGAM220 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM220 folded precursor RNA, herein designated VGAM FOLDED PRECURSOR RNA, into VGAM220 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM220 RNA is designated SEQ ID:555, and is provided hereinbelow with reference to the sequence listing part.

VGAM220 host target gene, herein designated VGAM HOST TARGET GENE, encodes a corresponding messenger RNA, VGAM220 host target RNA, herein designated VGAM HOST TARGET RNA. VGAM220 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM220 RNA, herein designated VGAM RNA, binds complementarily to one or more host target binding sites located in untranslated regions of VGAM220 host target RNA, herein designated VGAM HOST TARGET RNA. This complementary binding is due to the fact that the nucleotide sequence of VGAM220 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM220 RNA, herein designated VGAM RNA, may have a different number of host target binding sites in untranslated regions of a VGAM220 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM220 RNA, herein designated VGAM RNA, to host target binding sites on VGAM220 host target RNA, herein designated VGAM HOST TARGET RNA, such as BINDING SITE I, BINDING SITE II and BINDING SITE III, inhibits translation of VGAM220 host target RNA, herein designated VGAM HOST TARGET RNA, into VGAM220 host target protein, herein designated VGAM HOST TARGET PROTEIN. VGAM host target protein is therefore outlined by a broken line.

It is appreciated that VGAM220 host target gene, herein designated VGAM HOST TARGET GENE, in fact represents a plurality of VGAM220 host target genes. The mRNA of each one of this plurality of VGAM220 host target genes comprises one or more host target binding sites, each having a nucleotide sequence which is at least partly complementary to VGAM220 RNA, herein designated VGAM RNA, and which when bound by VGAM220 RNA, herein designated VGAM RNA, causes inhibition of translation of respective one or more VGAM220 host target proteins.

It is further appreciated by one skilled in the art that the mode of translational inhibition illustrated by FIG. 1 with specific reference to translational inhibition exerted by VGAM220 gene, herein designated VGAM GENE, on one or more VGAM220 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM220 is inhibition of expression of host target genes, as part of a novel viral mechanism of attacking a host. Accordingly, utilities of VGAM220 include diagnosis, prevention and treatment of viral infection by Vaccinia virus. Specific functions, and accordingly utilities, of VGAM220 correlate with, and may be deduced from, the identity of the host target genes which VGAM220 binds and inhibits, and the function of these host target genes, as elaborated hereinbelow.

Nucleotide sequences of the VGAM220 precursor RNA, herein designated VGAM PRECURSOR RNA, and of the diced VGAM220 RNA, herein designated VGAM RNA, and a schematic representation of the secondary folding of VGAM220 folded precursor RNA, herein designated VGAM FOLDED PRECURSOR RNA, of VGAM220 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM220 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 221 (VGAM221) viral gene, which modulates expression of respective host target genes thereof, the function and utility of which host target genes is known in the art.

VGAM221 is a novel bioinformatically detected regulatory, non protein coding, viral micro RNA (miRNA) gene. The method by which VGAM221 was detected is described hereinabove with reference to FIGS. 2-8.

VGAM221 gene, herein designated VGAM GENE, is a viral gene contained in the genome of Vaccinia virus. VGAM221 host target gene, herein designated VGAM HOST TARGET GENE, is a human gene contained in the human genome.

VGAM221 gene, herein designated VGAM GENE, encodes a VGAM221 precursor RNA, herein designated VGAM PRECURSOR RNA. Similar to other miRNA genes, and unlike most ordinary genes, VGAM221 precursor RNA, herein designated VGAM PRECURSOR RNA, does not encode a protein. A nucleotide sequence identical or highly similar to the nucleotide sequence of VGAM221 precursor RNA is designated SEQ ID:207, and is provided hereinbelow with reference to the sequence listing part. Nucleotide sequence SEQ ID:207 is located at position 116795 relative to the genome of Vaccinia virus.

VGAM221 precursor RNA, herein designated VGAM PRECURSOR RNA, folds onto itself, forming VGAM221 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM221 folded precursor RNA, herein designated VGAM FOLDED PRECURSOR RNA, into VGAM221 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM221 RNA is designated SEQ ID:556, and is provided hereinbelow with reference to the sequence listing part.

VGAM221 host target gene, herein designated VGAM HOST TARGET GENE, encodes a corresponding messenger RNA, VGAM221 host target RNA, herein designated VGAM HOST TARGET RNA. VGAM221 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM221 RNA, herein designated VGAM RNA, binds complementarily to one or more host target binding sites located in untranslated regions of VGAM221 host target RNA, herein designated VGAM HOST TARGET RNA. This complementary binding is due to the fact that the nucleotide sequence of VGAM221 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM221 RNA, herein designated VGAM RNA, may have a different number of host target binding sites in untranslated regions of a VGAM221 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM221 RNA, herein designated VGAM RNA, to host target binding sites on VGAM221 host target RNA, herein designated VGAM HOST TARGET RNA, such as BINDING SITE I, BINDING SITE II and BINDING SITE III, inhibits translation of VGAM221 host target RNA, herein designated VGAM HOST TARGET RNA, into VGAM221 host target protein, herein designated VGAM HOST TARGET PROTEIN. VGAM host target protein is therefore outlined by a broken line.

It is appreciated that VGAM221 host target gene, herein designated VGAM HOST TARGET GENE, in fact represents a plurality of VGAM221 host target genes. The mRNA of each one of this plurality of VGAM221 host target genes comprises one or more host target binding sites, each having a nucleotide sequence which is at least partly complementary to VGAM221 RNA, herein designated VGAM RNA, and which when bound by VGAM221 RNA, herein designated VGAM RNA, causes inhibition of translation of respective one or more VGAM221 host target proteins.

It is further appreciated by one skilled in the art that the mode of translational inhibition illustrated by FIG. 1 with specific reference to translational inhibition exerted by VGAM221 gene, herein designated VGAM GENE, on one or more VGAM221 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM221 is inhibition of expression of host target genes, as part of a novel viral mechanism of attacking a host. Accordingly, utilities of VGAM221 include diagnosis, prevention and treatment of viral infection by Vaccinia virus. Specific functions, and accordingly utilities, of VGAM221 correlate with, and may be deduced from, the identity of the host target genes which VGAM221 binds and inhibits, and the function of these host target genes, as elaborated hereinbelow.

Nucleotide sequences of the VGAM221 precursor RNA, herein designated VGAM PRECURSOR RNA, and of the diced VGAM221 RNA, herein designated VGAM RNA, and a schematic representation of the secondary folding of VGAM221 folded precursor RNA, herein designated VGAM FOLDED PRECURSOR RNA, of VGAM221 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM221 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 222 (VGAM222) viral gene, which modulates expression of respective host target genes thereof, the function and utility of which host target genes is known in the art.

VGAM222 is a novel bioinformatically detected regulatory, non protein coding, viral micro RNA (miRNA) gene. The method by which VGAM222 was detected is described hereinabove with reference to FIGS. 2-8.

VGAM222 gene, herein designated VGAM GENE, is a viral gene contained in the genome of Vaccinia virus. VGAM222 host target gene, herein designated VGAM HOST TARGET GENE, is a human gene contained in the human genome.

VGAM222 gene, herein designated VGAM GENE, encodes a VGAM222 precursor RNA, herein designated VGAM PRECURSOR RNA. Similar to other miRNA genes, and unlike most ordinary genes, VGAM222 precursor RNA, herein designated VGAM PRECURSOR RNA, does not encode a protein. A nucleotide sequence identical or highly similar to the nucleotide sequence of VGAM222 precursor RNA is designated SEQ ID:208, and is provided hereinbelow with reference to the sequence listing part. Nucleotide sequence SEQ ID:208 is located at position 117498 relative to the genome of Vaccinia virus.

VGAM222 precursor RNA, herein designated VGAM PRECURSOR RNA, folds onto itself, forming VGAM222 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM222 folded precursor RNA, herein designated VGAM FOLDED PRECURSOR RNA, into VGAM222 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 89%) nucleotide sequence of VGAM222 RNA is designated SEQ ID:557, and is provided hereinbelow with reference to the sequence listing part.

VGAM222 host target gene, herein designated VGAM HOST TARGET GENE, encodes a corresponding messenger RNA, VGAM222 host target RNA, herein designated VGAM HOST TARGET RNA. VGAM222 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM222 RNA, herein designated VGAM RNA, binds complementarily to one or more host target binding sites located in untranslated regions of VGAM222 host target RNA, herein designated VGAM HOST TARGET RNA. This complementary binding is due to the fact that the nucleotide sequence of VGAM222 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM222 RNA, herein designated VGAM RNA, may have a different number of host target binding sites in untranslated regions of a VGAM222 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM222 RNA, herein designated VGAM RNA, to host target binding sites on VGAM222 host target RNA, herein designated VGAM HOST TARGET RNA, such as BINDING SITE I, BINDING SITE II and BINDING SITE III, inhibits translation of VGAM222 host target RNA, herein designated VGAM HOST TARGET RNA, into VGAM222 host target protein, herein designated VGAM HOST TARGET PROTEIN. VGAM host target protein is therefore outlined by a broken line.

It is appreciated that VGAM222 host target gene, herein designated VGAM HOST TARGET GENE, in fact represents a plurality of VGAM222 host target genes. The mRNA of each one of this plurality of VGAM222 host target genes comprises one or more host target binding sites, each having a nucleotide sequence which is at least partly complementary to VGAM222 RNA, herein designated VGAM RNA, and which when bound by VGAM222 RNA, herein designated VGAM RNA, causes inhibition of translation of respective one or more VGAM222 host target proteins.

It is further appreciated by one skilled in the art that the mode of translational inhibition illustrated by FIG. 1 with specific reference to translational inhibition exerted by VGAM222 gene, herein designated VGAM GENE, on one or more VGAM222 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM222 is inhibition of expression of host target genes, as part of a novel viral mechanism of attacking a host. Accordingly, utilities of VGAM222 include diagnosis, prevention and treatment of viral infection by Vaccinia virus. Specific functions, and accordingly utilities, of VGAM222 correlate with, and may be deduced from, the identity of the host target genes which VGAM222 binds and inhibits, and the function of these host target genes, as elaborated hereinbelow.

Nucleotide sequences of the VGAM222 precursor RNA, herein designated VGAM PRECURSOR RNA, and of the diced VGAM222 RNA, herein designated VGAM RNA, and a schematic representation of the secondary folding of VGAM222 folded precursor RNA, herein designated VGAM FOLDED PRECURSOR RNA, of VGAM222 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM222 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 223 (VGAM223) viral gene, which modulates expression of respective host target genes thereof, the function and utility of which host target genes is known in the art.

VGAM223 is a novel bioinformatically detected regulatory, non protein coding, viral micro RNA (miRNA) gene. The method by which VGAM223 was detected is described hereinabove with reference to FIGS. 2-8.

VGAM223 gene, herein designated VGAM GENE, is a viral gene contained in the genome of Vaccinia virus. VGAM223 host target gene, herein designated VGAM HOST TARGET GENE, is a human gene contained in the human genome.

VGAM223 gene, herein designated VGAM GENE, encodes a VGAM223 precursor RNA, herein designated VGAM PRECURSOR RNA. Similar to other miRNA genes, and unlike most ordinary genes, VGAM223 precursor RNA, herein designated VGAM PRECURSOR RNA, does not encode a protein. A nucleotide sequence identical or highly similar to the nucleotide sequence of VGAM223 precursor RNA is designated SEQ ID:209, and is provided hereinbelow with reference to the sequence listing part. Nucleotide sequence SEQ ID:209 is located at position 117715 relative to the genome of Vaccinia virus.

VGAM223 precursor RNA, herein designated VGAM PRECURSOR RNA, folds onto itself, forming VGAM223 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM223 folded precursor RNA, herein designated VGAM FOLDED PRECURSOR RNA, into VGAM223 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 87%) nucleotide sequence of VGAM223 RNA is designated SEQ ID:558, and is provided hereinbelow with reference to the sequence listing part.

VGAM223 host target gene, herein designated VGAM HOST TARGET GENE, encodes a corresponding messenger RNA, VGAM223 host target RNA, herein designated VGAM HOST TARGET RNA. VGAM223 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM223 RNA, herein designated VGAM RNA, binds complementarily to one or more host target binding sites located in untranslated regions of VGAM223 host target RNA, herein designated VGAM HOST TARGET RNA. This complementary binding is due to the fact that the nucleotide sequence of VGAM223 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM223 RNA, herein designated VGAM RNA, may have a different number of host target binding sites in untranslated regions of a VGAM223 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM223 RNA, herein designated VGAM RNA, to host target binding sites on VGAM223 host target RNA, herein designated VGAM HOST TARGET RNA, such as BINDING SITE I, BINDING SITE II and BINDING SITE III, inhibits translation of VGAM223 host target RNA, herein designated VGAM HOST TARGET RNA, into VGAM223 host target protein, herein designated VGAM HOST TARGET PROTEIN. VGAM host target protein is therefore outlined by a broken line.

It is appreciated that VGAM223 host target gene, herein designated VGAM HOST TARGET GENE, in fact represents a plurality of VGAM223 host target genes. The mRNA of each one of this plurality of VGAM223 host target genes comprises one or more host target binding sites, each having a nucleotide sequence which is at least partly complementary to VGAM223 RNA, herein designated VGAM RNA, and which when bound by VGAM223 RNA, herein designated VGAM RNA, causes inhibition of translation of respective one or more VGAM223 host target proteins.

It is further appreciated by one skilled in the art that the mode of translational inhibition illustrated by FIG. 1 with specific reference to translational inhibition exerted by VGAM223 gene, herein designated VGAM GENE, on one or more VGAM223 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM223 is inhibition of expression of host target genes, as part of a novel viral mechanism of attacking a host. Accordingly, utilities of VGAM223 include diagnosis, prevention and treatment of viral infection by Vaccinia virus. Specific functions, and accordingly utilities, of VGAM223 correlate with, and may be deduced from, the identity of the host target genes which VGAM223 binds and inhibits, and the function of these host target genes, as elaborated hereinbelow.

Nucleotide sequences of the VGAM223 precursor RNA, herein designated VGAM PRECURSOR RNA, and of the diced VGAM223 RNA, herein designated VGAM RNA, and a schematic representation of the secondary folding of VGAM223 folded precursor RNA, herein designated VGAM FOLDED PRECURSOR RNA, of VGAM223 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM223 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 224 (VGAM224) viral gene, which modulates expression of respective host target genes thereof, the function and utility of which host target genes is known in the art.

VGAM224 is a novel bioinformatically detected regulatory, non protein coding, viral micro RNA (miRNA) gene. The method by which VGAM224 was detected is described hereinabove with reference to FIGS. 2-8.

VGAM224 gene, herein designated VGAM GENE, is a viral gene contained in the genome of Vaccinia virus. VGAM224 host target gene, herein designated VGAM HOST TARGET GENE, is a human gene contained in the human genome.

VGAM224 gene, herein designated VGAM GENE, encodes a VGAM224 precursor RNA, herein designated VGAM PRECURSOR RNA. Similar to other miRNA genes, and unlike most ordinary genes, VGAM224 precursor RNA, herein designated VGAM PRECURSOR RNA, does not encode a protein. A nucleotide sequence identical or highly similar to the nucleotide sequence of VGAM224 precursor RNA is designated SEQ ID:210, and is provided hereinbelow with reference to the sequence listing part. Nucleotide sequence SEQ ID:210 is located at position 119904 relative to the genome of Vaccinia virus.

VGAM224 precursor RNA, herein designated VGAM PRECURSOR RNA, folds onto itself, forming VGAM224 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM224 folded precursor RNA, herein designated VGAM FOLDED PRECURSOR RNA, into VGAM224 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 81%) nucleotide sequence of VGAM224 RNA is designated SEQ ID:559, and is provided hereinbelow with reference to the sequence listing part.

VGAM224 host target gene, herein designated VGAM HOST TARGET GENE, encodes a corresponding messenger RNA, VGAM224 host target RNA, herein designated VGAM HOST TARGET RNA. VGAM224 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM224 RNA, herein designated VGAM RNA, binds complementarily to one or more host target binding sites located in untranslated regions of VGAM224 host target RNA, herein designated VGAM HOST TARGET RNA. This complementary binding is due to the fact that the nucleotide sequence of VGAM224 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM224 RNA, herein designated VGAM RNA, may have a different number of host target binding sites in untranslated regions of a VGAM224 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM224 RNA, herein designated VGAM RNA, to host target binding sites on VGAM224 host target RNA, herein designated VGAM HOST TARGET RNA, such as BINDING SITE I, BINDING SITE II and BINDING SITE III, inhibits translation of VGAM224 host target RNA, herein designated VGAM HOST TARGET RNA, into VGAM224 host target protein, herein designated VGAM HOST TARGET PROTEIN. VGAM host target protein is therefore outlined by a broken line.

It is appreciated that VGAM224 host target gene, herein designated VGAM HOST TARGET GENE, in fact represents a plurality of VGAM224 host target genes. The mRNA of each one of this plurality of VGAM224 host target genes comprises one or more host target binding sites, each having a nucleotide sequence which is at least partly complementary to VGAM224 RNA, herein designated VGAM RNA, and which when bound by VGAM224 RNA, herein designated VGAM RNA, causes inhibition of translation of respective one or more VGAM224 host target proteins.

It is further appreciated by one skilled in the art that the mode of translational inhibition illustrated by FIG. 1 with specific reference to translational inhibition exerted by VGAM224 gene, herein designated VGAM GENE, on one or more VGAM224 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM224 is inhibition of expression of host target genes, as part of a novel viral mechanism of attacking a host. Accordingly, utilities of VGAM224 include diagnosis, prevention and treatment of viral infection by Vaccinia virus. Specific functions, and accordingly utilities, of VGAM224 correlate with, and may be deduced from, the identity of the host target genes which VGAM224 binds and inhibits, and the function of these host target genes, as elaborated hereinbelow.

Nucleotide sequences of the VGAM224 precursor RNA, herein designated VGAM PRECURSOR RNA, and of the diced VGAM224 RNA, herein designated VGAM RNA, and a schematic representation of the secondary folding of VGAM224 folded precursor RNA, herein designated VGAM FOLDED PRECURSOR RNA, of VGAM224 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM224 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 225 (VGAM225) viral gene, which modulates expression of respective host target genes thereof, the function and utility of which host target genes is known in the art.

VGAM225 is a novel bioinformatically detected regulatory, non protein coding, viral micro RNA (miRNA) gene. The method by which VGAM225 was detected is described hereinabove with reference to FIGS. 2-8.

VGAM225 gene, herein designated VGAM GENE, is a viral gene contained in the genome of Vaccinia virus. VGAM225 host target gene, herein designated VGAM HOST TARGET GENE, is a human gene contained in the human genome.

VGAM225 gene, herein designated VGAM GENE, encodes a VGAM225 precursor RNA, herein designated VGAM PRECURSOR RNA. Similar to other miRNA genes, and unlike most ordinary genes, VGAM225 precursor RNA, herein designated VGAM PRECURSOR RNA, does not encode a protein. A nucleotide sequence identical or highly similar to the nucleotide sequence of VGAM225 precursor RNA is designated SEQ ID:211, and is provided hereinbelow with reference to the sequence listing part. Nucleotide sequence SEQ ID:211 is located at position 118961 relative to the genome of Vaccinia virus.

VGAM225 precursor RNA, herein designated VGAM PRECURSOR RNA, folds onto itself, forming VGAM225 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM225 folded precursor RNA, herein designated VGAM FOLDED PRECURSOR RNA, into VGAM225 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 86%) nucleotide sequence of VGAM225 RNA is designated SEQ ID:560, and is provided hereinbelow with reference to the sequence listing part.

VGAM225 host target gene, herein designated VGAM HOST TARGET GENE, encodes a corresponding messenger RNA, VGAM225 host target RNA, herein designated VGAM HOST TARGET RNA. VGAM225 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM225 RNA, herein designated VGAM RNA, binds complementarily to one or more host target binding sites located in untranslated regions of VGAM225 host target RNA, herein designated VGAM HOST TARGET RNA. This complementary binding is due to the fact that the nucleotide sequence of VGAM225 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM225 RNA, herein designated VGAM RNA, may have a different number of host target binding sites in untranslated regions of a VGAM225 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM225 RNA, herein designated VGAM RNA, to host target binding sites on VGAM225 host target RNA, herein designated VGAM HOST TARGET RNA, such as BINDING SITE I, BINDING SITE II and BINDING SITE III, inhibits translation of VGAM225 host target RNA, herein designated VGAM HOST TARGET RNA, into VGAM225 host target protein, herein designated VGAM HOST TARGET PROTEIN. VGAM host target protein is therefore outlined by a broken line.

It is appreciated that VGAM225 host target gene, herein designated VGAM HOST TARGET GENE, in fact represents a plurality of VGAM225 host target genes. The mRNA of each one of this plurality of VGAM225 host target genes comprises one or more host target binding sites, each having a nucleotide sequence which is at least partly complementary to VGAM225 RNA, herein designated VGAM RNA, and which when bound by VGAM225 RNA, herein designated VGAM RNA, causes inhibition of translation of respective one or more VGAM225 host target proteins.

It is further appreciated by one skilled in the art that the mode of translational inhibition illustrated by FIG. 1 with specific reference to translational inhibition exerted by VGAM225 gene, herein designated VGAM GENE, on one or more VGAM225 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM225 is inhibition of expression of host target genes, as part of a novel viral mechanism of attacking a host. Accordingly, utilities of VGAM225 include diagnosis, prevention and treatment of viral infection by Vaccinia virus. Specific functions, and accordingly utilities, of VGAM225 correlate with, and may be deduced from, the identity of the host target genes which VGAM225 binds and inhibits, and the function of these host target genes, as elaborated hereinbelow.

Nucleotide sequences of the VGAM225 precursor RNA, herein designated VGAM PRECURSOR RNA, and of the diced VGAM225 RNA, herein designated VGAM RNA, and a schematic representation of the secondary folding of VGAM225 folded precursor RNA, herein designated VGAM FOLDED PRECURSOR RNA, of VGAM225 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM225 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 226 (VGAM226) viral gene, which modulates expression of respective host target genes thereof, the function and utility of which host target genes is known in the art.

VGAM226 is a novel bioinformatically detected regulatory, non protein coding, viral micro RNA (miRNA) gene. The method by which VGAM226 was detected is described hereinabove with reference to FIGS. 2-8.

VGAM226 gene, herein designated VGAM GENE, is a viral gene contained in the genome of Vaccinia virus. VGAM226 host target gene, herein designated VGAM HOST TARGET GENE, is a human gene contained in the human genome.

VGAM226 gene, herein designated VGAM GENE, encodes a VGAM226 precursor RNA, herein designated VGAM PRECURSOR RNA. Similar to other miRNA genes, and unlike most ordinary genes, VGAM226 precursor RNA, herein designated VGAM PRECURSOR RNA, does not encode a protein. A nucleotide sequence identical or highly similar to the nucleotide sequence of VGAM226 precursor RNA is designated SEQ ID:212, and is provided hereinbelow with reference to the sequence listing part. Nucleotide sequence SEQ ID:212 is located at position 118120 relative to the genome of Vaccinia virus.

VGAM226 precursor RNA, herein designated VGAM PRECURSOR RNA, folds onto itself, forming VGAM226 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM226 folded precursor RNA, herein designated VGAM FOLDED PRECURSOR RNA, into VGAM226 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 74%) nucleotide sequence of VGAM226 RNA is designated SEQ ID:561, and is provided hereinbelow with reference to the sequence listing part.

VGAM226 host target gene, herein designated VGAM HOST TARGET GENE, encodes a corresponding messenger RNA, VGAM226 host target RNA, herein designated VGAM HOST TARGET RNA. VGAM226 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM226 RNA, herein designated VGAM RNA, binds complementarily to one or more host target binding sites located in untranslated regions of VGAM226 host target RNA, herein designated VGAM HOST TARGET RNA. This complementary binding is due to the fact that the nucleotide sequence of VGAM226 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM226 RNA, herein designated VGAM RNA, may have a different number of host target binding sites in untranslated regions of a VGAM226 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM226 RNA, herein designated VGAM RNA, to host target binding sites on VGAM226 host target RNA, herein designated VGAM HOST TARGET RNA, such as BINDING SITE I, BINDING SITE II and BINDING SITE III, inhibits translation of VGAM226 host target RNA, herein designated VGAM HOST TARGET RNA, into VGAM226 host target protein, herein designated VGAM HOST TARGET PROTEIN. VGAM host target protein is therefore outlined by a broken line.

It is appreciated that VGAM226 host target gene, herein designated VGAM HOST TARGET GENE, in fact represents a plurality of VGAM226 host target genes. The mRNA of each one of this plurality of VGAM226 host target genes comprises one or more host target binding sites, each having a nucleotide sequence which is at least partly complementary to VGAM226 RNA, herein designated VGAM RNA, and which when bound by VGAM226 RNA, herein designated VGAM RNA, causes inhibition of translation of respective one or more VGAM226 host target proteins.

It is further appreciated by one skilled in the art that the mode of translational inhibition illustrated by FIG. 1 with specific reference to translational inhibition exerted by VGAM226 gene, herein designated VGAM GENE, on one or more VGAM226 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM226 is inhibition of expression of host target genes, as part of a novel viral mechanism of attacking a host. Accordingly, utilities of VGAM226 include diagnosis, prevention and treatment of viral infection by Vaccinia virus. Specific functions, and accordingly utilities, of VGAM226 correlate with, and may be deduced from, the identity of the host target genes which VGAM226 binds and inhibits, and the function of these host target genes, as elaborated hereinbelow.

Nucleotide sequences of the VGAM226 precursor RNA, herein designated VGAM PRECURSOR RNA, and of the diced VGAM226 RNA, herein designated VGAM RNA, and a schematic representation of the secondary folding of VGAM226 folded precursor RNA, herein designated VGAM FOLDED PRECURSOR RNA, of VGAM226 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM226 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 227 (VGAM227) viral gene, which modulates expression of respective host target genes thereof, the function and utility of which host target genes is known in the art.

VGAM227 is a novel bioinformatically detected regulatory, non protein coding, viral micro RNA (miRNA) gene. The method by which VGAM227 was detected is described hereinabove with reference to FIGS. 2-8.

VGAM227 gene, herein designated VGAM GENE, is a viral gene contained in the genome of Vaccinia virus. VGAM227 host target gene, herein designated VGAM HOST TARGET GENE, is a human gene contained in the human genome.

VGAM227 gene, herein designated VGAM GENE, encodes a VGAM227 precursor RNA, herein designated VGAM PRECURSOR RNA. Similar to other miRNA genes, and unlike most ordinary genes, VGAM227 precursor RNA, herein designated VGAM PRECURSOR RNA, does not encode a protein. A nucleotide sequence identical or highly similar to the nucleotide sequence of VGAM227 precursor RNA is designated SEQ ID:213, and is provided hereinbelow with reference to the sequence listing part. Nucleotide sequence SEQ ID:213 is located at position 118560 relative to the genome of Vaccinia virus.

VGAM227 precursor RNA, herein designated VGAM PRECURSOR RNA, folds onto itself, forming VGAM227 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM227 folded precursor RNA, herein designated VGAM FOLDED PRECURSOR RNA, into VGAM227 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM227 RNA is designated SEQ ID:562, and is provided hereinbelow with reference to the sequence listing part.

VGAM227 host target gene, herein designated VGAM HOST TARGET GENE, encodes a corresponding messenger RNA, VGAM227 host target RNA, herein designated VGAM HOST TARGET RNA. VGAM227 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM227 RNA, herein designated VGAM RNA, binds complementarily to one or more host target binding sites located in untranslated regions of VGAM227 host target RNA, herein designated VGAM HOST TARGET RNA. This complementary binding is due to the fact that the nucleotide sequence of VGAM227 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM227 RNA, herein designated VGAM RNA, may have a different number of host target binding sites in untranslated regions of a VGAM227 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM227 RNA, herein designated VGAM RNA, to host target binding sites on VGAM227 host target RNA, herein designated VGAM HOST TARGET RNA, such as BINDING SITE I, BINDING SITE II and BINDING SITE III, inhibits translation of VGAM227 host target RNA, herein designated VGAM HOST TARGET RNA, into VGAM227 host target protein, herein designated VGAM HOST TARGET PROTEIN. VGAM host target protein is therefore outlined by a broken line.

It is appreciated that VGAM227 host target gene, herein designated VGAM HOST TARGET GENE, in fact represents a plurality of VGAM227 host target genes. The mRNA of each one of this plurality of VGAM227 host target genes comprises one or more host target binding sites, each having a nucleotide sequence which is at least partly complementary to VGAM227 RNA, herein designated VGAM RNA, and which when bound by VGAM227 RNA, herein designated VGAM RNA, causes inhibition of translation of respective one or more VGAM227 host target proteins.

It is further appreciated by one skilled in the art that the mode of translational inhibition illustrated by FIG. 1 with specific reference to translational inhibition exerted by VGAM227 gene, herein designated VGAM GENE, on one or more VGAM227 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM227 is inhibition of expression of host target genes, as part of a novel viral mechanism of attacking a host. Accordingly, utilities of VGAM227 include diagnosis, prevention and treatment of viral infection by Vaccinia virus. Specific functions, and accordingly utilities, of VGAM227 correlate with, and may be deduced from, the identity of the host target genes which VGAM227 binds and inhibits, and the function of these host target genes, as elaborated hereinbelow.

Nucleotide sequences of the VGAM227 precursor RNA, herein designated VGAM PRECURSOR RNA, and of the diced VGAM227 RNA, herein designated VGAM RNA, and a schematic representation of the secondary folding of VGAM227 folded precursor RNA, herein designated VGAM FOLDED PRECURSOR RNA, of VGAM227 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM227 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 228 (VGAM228) viral gene, which modulates expression of respective host target genes thereof, the function and utility of which host target genes is known in the art.

VGAM228 is a novel bioinformatically detected regulatory, non protein coding, viral micro RNA (miRNA) gene. The method by which VGAM228 was detected is described hereinabove with reference to FIGS. 2-8.

VGAM228 gene, herein designated VGAM GENE, is a viral gene contained in the genome of Vaccinia virus. VGAM228 host target gene, herein designated VGAM HOST TARGET GENE, is a human gene contained in the human genome.

VGAM228 gene, herein designated VGAM GENE, encodes a VGAM228 precursor RNA, herein designated VGAM PRECURSOR RNA. Similar to other miRNA genes, and unlike most ordinary genes, VGAM228 precursor RNA, herein designated VGAM PRECURSOR RNA, does not encode a protein. A nucleotide sequence identical or highly similar to the nucleotide sequence of VGAM228 precursor RNA is designated SEQ ID:214, and is provided hereinbelow with reference to the sequence listing part. Nucleotide sequence SEQ ID:214 is located at position 120881 relative to the genome of Vaccinia virus.

VGAM228 precursor RNA, herein designated VGAM PRECURSOR RNA, folds onto itself, forming VGAM228 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM228 folded precursor RNA, herein designated VGAM FOLDED PRECURSOR RNA, into VGAM228 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM228 RNA is designated SEQ ID:563, and is provided hereinbelow with reference to the sequence listing part.

VGAM228 host target gene, herein designated VGAM HOST TARGET GENE, encodes a corresponding messenger RNA, VGAM228 host target RNA, herein designated VGAM HOST TARGET RNA. VGAM228 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM228 RNA, herein designated VGAM RNA, binds complementarily to one or more host target binding sites located in untranslated regions of VGAM228 host target RNA, herein designated VGAM HOST TARGET RNA. This complementary binding is due to the fact that the nucleotide sequence of VGAM228 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM228 RNA, herein designated VGAM RNA, may have a different number of host target binding sites in untranslated regions of a VGAM228 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM228 RNA, herein designated VGAM RNA, to host target binding sites on VGAM228 host target RNA, herein designated VGAM HOST TARGET RNA, such as BINDING SITE I, BINDING SITE II and BINDING SITE III, inhibits translation of VGAM228 host target RNA, herein designated VGAM HOST TARGET RNA, into VGAM228 host target protein, herein designated VGAM HOST TARGET PROTEIN. VGAM host target protein is therefore outlined by a broken line.

It is appreciated that VGAM228 host target gene, herein designated VGAM HOST TARGET GENE, in fact represents a plurality of VGAM228 host target genes. The mRNA of each one of this plurality of VGAM228 host target genes comprises one or more host target binding sites, each having a nucleotide sequence which is at least partly complementary to VGAM228 RNA, herein designated VGAM RNA, and which when bound by VGAM228 RNA, herein designated VGAM RNA, causes inhibition of translation of respective one or more VGAM228 host target proteins.

It is further appreciated by one skilled in the art that the mode of translational inhibition illustrated by FIG. 1 with specific reference to translational inhibition exerted by VGAM228 gene, herein designated VGAM GENE, on one or more VGAM228 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM228 is inhibition of expression of host target genes, as part of a novel viral mechanism of attacking a host. Accordingly, utilities of VGAM228 include diagnosis, prevention and treatment of viral infection by Vaccinia virus. Specific functions, and accordingly utilities, of VGAM228 correlate with, and may be deduced from, the identity of the host target genes which VGAM228 binds and inhibits, and the function of these host target genes, as elaborated hereinbelow.

Nucleotide sequences of the VGAM228 precursor RNA, herein designated VGAM PRECURSOR RNA, and of the diced VGAM228 RNA, herein designated VGAM RNA, and a schematic representation of the secondary folding of VGAM228 folded precursor RNA, herein designated VGAM FOLDED PRECURSOR RNA, of VGAM228 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM228 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 229 (VGAM229) viral gene, which modulates expression of respective host target genes thereof, the function and utility of which host target genes is known in the art.

VGAM229 is a novel bioinformatically detected regulatory, non protein coding, viral micro RNA (miRNA) gene. The method by which VGAM229 was detected is described hereinabove with reference to FIGS. 2-8.

VGAM229 gene, herein designated VGAM GENE, is a viral gene contained in the genome of Vaccinia virus. VGAM229 host target gene, herein designated VGAM HOST TARGET GENE, is a human gene contained in the human genome.

VGAM229 gene, herein designated VGAM GENE, encodes a VGAM229 precursor RNA, herein designated VGAM PRECURSOR RNA. Similar to other miRNA genes, and unlike most ordinary genes, VGAM229 precursor RNA, herein designated VGAM PRECURSOR RNA, does not encode a protein. A nucleotide sequence identical or highly similar to the nucleotide sequence of VGAM229 precursor RNA is designated SEQ ID:215, and is provided hereinbelow with reference to the sequence listing part. Nucleotide sequence SEQ ID:215 is located at position 122419 relative to the genome of Vaccinia virus.

VGAM229 precursor RNA, herein designated VGAM PRECURSOR RNA, folds onto itself, forming VGAM229 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM229 folded precursor RNA, herein designated VGAM FOLDED PRECURSOR RNA, into VGAM229 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 90%) nucleotide sequence of VGAM229 RNA is designated SEQ ID:564, and is provided hereinbelow with reference to the sequence listing part.

VGAM229 host target gene, herein designated VGAM HOST TARGET GENE, encodes a corresponding messenger RNA, VGAM229 host target RNA, herein designated VGAM HOST TARGET RNA. VGAM229 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM229 RNA, herein designated VGAM RNA, binds complementarily to one or more host target binding sites located in untranslated regions of VGAM229 host target RNA, herein designated VGAM HOST TARGET RNA. This complementary binding is due to the fact that the nucleotide sequence of VGAM229 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM229 RNA, herein designated VGAM RNA, may have a different number of host target binding sites in untranslated regions of a VGAM229 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM229 RNA, herein designated VGAM RNA, to host target binding sites on VGAM229 host target RNA, herein designated VGAM HOST TARGET RNA, such as BINDING SITE I, BINDING SITE II and BINDING SITE III, inhibits translation of VGAM229 host target RNA, herein designated VGAM HOST TARGET RNA, into VGAM229 host target protein, herein designated VGAM HOST TARGET PROTEIN. VGAM host target protein is therefore outlined by a broken line.

It is appreciated that VGAM229 host target gene, herein designated VGAM HOST TARGET GENE, in fact represents a plurality of VGAM229 host target genes. The mRNA of each one of this plurality of VGAM229 host target genes comprises one or more host target binding sites, each having a nucleotide sequence which is at least partly complementary to VGAM229 RNA, herein designated VGAM RNA, and which when bound by VGAM229 RNA, herein designated VGAM RNA, causes inhibition of translation of respective one or more VGAM229 host target proteins.

It is further appreciated by one skilled in the art that the mode of translational inhibition illustrated by FIG. 1 with specific reference to translational inhibition exerted by VGAM229 gene, herein designated VGAM GENE, on one or more VGAM229 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM229 is inhibition of expression of host target genes, as part of a novel viral mechanism of attacking a host. Accordingly, utilities of VGAM229 include diagnosis, prevention and treatment of viral infection by Vaccinia virus. Specific functions, and accordingly utilities, of VGAM229 correlate with, and may be deduced from, the identity of the host target genes which VGAM229 binds and inhibits, and the function of these host target genes, as elaborated hereinbelow.

Nucleotide sequences of the VGAM229 precursor RNA, herein designated VGAM PRECURSOR RNA, and of the diced VGAM229 RNA, herein designated VGAM RNA, and a schematic representation of the secondary folding of VGAM229 folded precursor RNA, herein designated VGAM FOLDED PRECURSOR RNA, of VGAM229 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM229 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 230 (VGAM230) viral gene, which modulates expression of respective host target genes thereof, the function and utility of which host target genes is known in the art.

VGAM230 is a novel bioinformatically detected regulatory, non protein coding, viral micro RNA (miRNA) gene. The method by which VGAM230 was detected is described hereinabove with reference to FIGS. 2-8.

VGAM230 gene, herein designated VGAM GENE, is a viral gene contained in the genome of Vaccinia virus. VGAM230 host target gene, herein designated VGAM HOST TARGET GENE, is a human gene contained in the human genome.

VGAM230 gene, herein designated VGAM GENE, encodes a VGAM230 precursor RNA, herein designated VGAM PRECURSOR RNA. Similar to other miRNA genes, and unlike most ordinary genes, VGAM230 precursor RNA, herein designated VGAM PRECURSOR RNA, does not encode a protein. A nucleotide sequence identical or highly similar to the nucleotide sequence of VGAM230 precursor RNA is designated SEQ ID:216, and is provided hereinbelow with reference to the sequence listing part. Nucleotide sequence SEQ ID:216 is located at position 125121 relative to the genome of Vaccinia virus.

VGAM230 precursor RNA, herein designated VGAM PRECURSOR RNA, folds onto itself, forming VGAM230 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM230 folded precursor RNA, herein designated VGAM FOLDED PRECURSOR RNA, into VGAM230 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 78%) nucleotide sequence of VGAM230 RNA is designated SEQ ID:565, and is provided hereinbelow with reference to the sequence listing part.

VGAM230 host target gene, herein designated VGAM HOST TARGET GENE, encodes a corresponding messenger RNA, VGAM230 host target RNA, herein designated VGAM HOST TARGET RNA. VGAM230 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM230 RNA, herein designated VGAM RNA, binds complementarily to one or more host target binding sites located in untranslated regions of VGAM230 host target RNA, herein designated VGAM HOST TARGET RNA. This complementary binding is due to the fact that the nucleotide sequence of VGAM230 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM230 RNA, herein designated VGAM RNA, may have a different number of host target binding sites in untranslated regions of a VGAM230 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM230 RNA, herein designated VGAM RNA, to host target binding sites on VGAM230 host target RNA, herein designated VGAM HOST TARGET RNA, such as BINDING SITE I, BINDING SITE II and BINDING SITE III, inhibits translation of VGAM230 host target RNA, herein designated VGAM HOST TARGET RNA, into VGAM230 host target protein, herein designated VGAM HOST TARGET PROTEIN. VGAM host target protein is therefore outlined by a broken line.

It is appreciated that VGAM230 host target gene, herein designated VGAM HOST TARGET GENE, in fact represents a plurality of VGAM230 host target genes. The mRNA of each one of this plurality of VGAM230 host target genes comprises one or more host target binding sites, each having a nucleotide sequence which is at least partly complementary to VGAM230 RNA, herein designated VGAM RNA, and which when bound by VGAM230 RNA, herein designated VGAM RNA, causes inhibition of translation of respective one or more VGAM230 host target proteins.

It is further appreciated by one skilled in the art that the mode of translational inhibition illustrated by FIG. 1 with specific reference to translational inhibition exerted by VGAM230 gene, herein designated VGAM GENE, on one or more VGAM230 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM230 is inhibition of expression of host target genes, as part of a novel viral mechanism of attacking a host. Accordingly, utilities of VGAM230 include diagnosis, prevention and treatment of viral infection by Vaccinia virus. Specific functions, and accordingly utilities, of VGAM230 correlate with, and may be deduced from, the identity of the host target genes which VGAM230 binds and inhibits, and the function of these host target genes, as elaborated hereinbelow.

Nucleotide sequences of the VGAM230 precursor RNA, herein designated VGAM PRECURSOR RNA, and of the diced VGAM230 RNA, herein designated VGAM RNA, and a schematic representation of the secondary folding of VGAM230 folded precursor RNA, herein designated VGAM FOLDED PRECURSOR RNA, of VGAM230 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM230 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 231 (VGAM231) viral gene, which modulates expression of respective host target genes thereof, the function and utility of which host target genes is known in the art.

VGAM231 is a novel bioinformatically detected regulatory, non protein coding, viral micro RNA (miRNA) gene. The method by which VGAM231 was detected is described hereinabove with reference to FIGS. 2-8.

VGAM231 gene, herein designated VGAM GENE, is a viral gene contained in the genome of Vaccinia virus. VGAM231 host target gene, herein designated VGAM HOST TARGET GENE, is a human gene contained in the human genome.

VGAM231 gene, herein designated VGAM GENE, encodes a VGAM231 precursor RNA, herein designated VGAM PRECURSOR RNA. Similar to other miRNA genes, and unlike most ordinary genes, VGAM231 precursor RNA, herein designated VGAM PRECURSOR RNA, does not encode a protein. A nucleotide sequence identical or highly similar to the nucleotide sequence of VGAM231 precursor RNA is designated SEQ ID:217, and is provided hereinbelow with reference to the sequence listing part. Nucleotide sequence SEQ ID:217 is located at position 125645 relative to the genome of Vaccinia virus.

VGAM231 precursor RNA, herein designated VGAM PRECURSOR RNA, folds onto itself, forming VGAM231 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM231 folded precursor RNA, herein designated VGAM FOLDED PRECURSOR RNA, into VGAM231 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 87%) nucleotide sequence of VGAM231 RNA is designated SEQ ID:566, and is provided hereinbelow with reference to the sequence listing part.

VGAM231 host target gene, herein designated VGAM HOST TARGET GENE, encodes a corresponding messenger RNA, VGAM231 host target RNA, herein designated VGAM HOST TARGET RNA. VGAM231 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM231 RNA, herein designated VGAM RNA, binds complementarily to one or more host target binding sites located in untranslated regions of VGAM231 host target RNA, herein designated VGAM HOST TARGET RNA. This complementary binding is due to the fact that the nucleotide sequence of VGAM231 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM231 RNA, herein designated VGAM RNA, may have a different number of host target binding sites in untranslated regions of a VGAM231 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM231 RNA, herein designated VGAM RNA, to host target binding sites on VGAM231 host target RNA, herein designated VGAM HOST TARGET RNA, such as BINDING SITE I, BINDING SITE II and BINDING SITE III, inhibits translation of VGAM231 host target RNA, herein designated VGAM HOST TARGET RNA, into VGAM231 host target protein, herein designated VGAM HOST TARGET PROTEIN. VGAM host target protein is therefore outlined by a broken line.

It is appreciated that VGAM231 host target gene, herein designated VGAM HOST TARGET GENE, in fact represents a plurality of VGAM231 host target genes. The mRNA of each one of this plurality of VGAM231 host target genes comprises one or more host target binding sites, each having a nucleotide sequence which is at least partly complementary to VGAM231 RNA, herein designated VGAM RNA, and which when bound by VGAM231 RNA, herein designated VGAM RNA, causes inhibition of translation of respective one or more VGAM231 host target proteins.

It is further appreciated by one skilled in the art that the mode of translational inhibition illustrated by FIG. 1 with specific reference to translational inhibition exerted by VGAM231 gene, herein designated VGAM GENE, on one or more VGAM231 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM231 is inhibition of expression of host target genes, as part of a novel viral mechanism of attacking a host. Accordingly, utilities of VGAM231 include diagnosis, prevention and treatment of viral infection by Vaccinia virus. Specific functions, and accordingly utilities, of VGAM231 correlate with, and may be deduced from, the identity of the host target genes which VGAM231 binds and inhibits, and the function of these host target genes, as elaborated hereinbelow.

Nucleotide sequences of the VGAM231 precursor RNA, herein designated VGAM PRECURSOR RNA, and of the diced VGAM231 RNA, herein designated VGAM RNA, and a schematic representation of the secondary folding of VGAM231 folded precursor RNA, herein designated VGAM FOLDED PRECURSOR RNA, of VGAM231 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM231 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 232 (VGAM232) viral gene, which modulates expression of respective host target genes thereof, the function and utility of which host target genes is known in the art.

VGAM232 is a novel bioinformatically detected regulatory, non protein coding, viral micro RNA (miRNA) gene. The method by which VGAM232 was detected is described hereinabove with reference to FIGS. 2-8.

VGAM232 gene, herein designated VGAM GENE, is a viral gene contained in the genome of Vaccinia virus. VGAM232 host target gene, herein designated VGAM HOST TARGET GENE, is a human gene contained in the human genome.

VGAM232 gene, herein designated VGAM GENE, encodes a VGAM232 precursor RNA, herein designated VGAM PRECURSOR RNA. Similar to other miRNA genes, and unlike most ordinary genes, VGAM232 precursor RNA, herein designated VGAM PRECURSOR RNA, does not encode a protein. A nucleotide sequence identical or highly similar to the nucleotide sequence of VGAM232 precursor RNA is designated SEQ ID:218, and is provided hereinbelow with reference to the sequence listing part. Nucleotide sequence SEQ ID:218 is located at position 125237 relative to the genome of Vaccinia virus.

VGAM232 precursor RNA, herein designated VGAM PRECURSOR RNA, folds onto itself, forming VGAM232 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM232 folded precursor RNA, herein designated VGAM FOLDED PRECURSOR RNA, into VGAM232 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 79%) nucleotide sequence of VGAM232 RNA is designated SEQ ID:567, and is provided hereinbelow with reference to the sequence listing part.

VGAM232 host target gene, herein designated VGAM HOST TARGET GENE, encodes a corresponding messenger RNA, VGAM232 host target RNA, herein designated VGAM HOST TARGET RNA. VGAM232 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM232 RNA, herein designated VGAM RNA, binds complementarily to one or more host target binding sites located in untranslated regions of VGAM232 host target RNA, herein designated VGAM HOST TARGET RNA. This complementary binding is due to the fact that the nucleotide sequence of VGAM232 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM232 RNA, herein designated VGAM RNA, may have a different number of host target binding sites in untranslated regions of a VGAM232 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM232 RNA, herein designated VGAM RNA, to host target binding sites on VGAM232 host target RNA, herein designated VGAM HOST TARGET RNA, such as BINDING SITE I, BINDING SITE II and BINDING SITE III, inhibits translation of VGAM232 host target RNA, herein designated VGAM HOST TARGET RNA, into VGAM232 host target protein, herein designated VGAM HOST TARGET PROTEIN. VGAM host target protein is therefore outlined by a broken line.

It is appreciated that VGAM232 host target gene, herein designated VGAM HOST TARGET GENE, in fact represents a plurality of VGAM232 host target genes. The mRNA of each one of this plurality of VGAM232 host target genes comprises one or more host target binding sites, each having a nucleotide sequence which is at least partly complementary to VGAM232 RNA, herein designated VGAM RNA, and which when bound by VGAM232 RNA, herein designated VGAM RNA, causes inhibition of translation of respective one or more VGAM232 host target proteins.

It is further appreciated by one skilled in the art that the mode of translational inhibition illustrated by FIG. 1 with specific reference to translational inhibition exerted by VGAM232 gene, herein designated VGAM GENE, on one or more VGAM232 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM232 is inhibition of expression of host target genes, as part of a novel viral mechanism of attacking a host. Accordingly, utilities of VGAM232 include diagnosis, prevention and treatment of viral infection by Vaccinia virus. Specific functions, and accordingly utilities, of VGAM232 correlate with, and may be deduced from, the identity of the host target genes which VGAM232 binds and inhibits, and the function of these host target genes, as elaborated hereinbelow.

Nucleotide sequences of the VGAM232 precursor RNA, herein designated VGAM PRECURSOR RNA, and of the diced VGAM232 RNA, herein designated VGAM RNA, and a schematic representation of the secondary folding of VGAM232 folded precursor RNA, herein designated VGAM FOLDED PRECURSOR RNA, of VGAM232 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM232 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 233 (VGAM233) viral gene, which modulates expression of respective host target genes thereof, the function and utility of which host target genes is known in the art.

VGAM233 is a novel bioinformatically detected regulatory, non protein coding, viral micro RNA (miRNA) gene. The method by which VGAM233 was detected is described hereinabove with reference to FIGS. 2-8.

VGAM233 gene, herein designated VGAM GENE, is a viral gene contained in the genome of Vaccinia virus. VGAM233 host target gene, herein designated VGAM HOST TARGET GENE, is a human gene contained in the human genome.

VGAM233 gene, herein designated VGAM GENE, encodes a VGAM233 precursor RNA, herein designated VGAM PRECURSOR RNA. Similar to other miRNA genes, and unlike most ordinary genes, VGAM233 precursor RNA, herein designated VGAM PRECURSOR RNA, does not encode a protein. A nucleotide sequence identical or highly similar to the nucleotide sequence of VGAM233 precursor RNA is designated SEQ ID:219, and is provided hereinbelow with reference to the sequence listing part. Nucleotide sequence SEQ ID:219 is located at position 125406 relative to the genome of Vaccinia virus.

VGAM233 precursor RNA, herein designated VGAM PRECURSOR RNA, folds onto itself, forming VGAM233 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM233 folded precursor RNA, herein designated VGAM FOLDED PRECURSOR RNA, into VGAM233 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 71%) nucleotide sequence of VGAM233 RNA is designated SEQ ID:568, and is provided hereinbelow with reference to the sequence listing part.

VGAM233 host target gene, herein designated VGAM HOST TARGET GENE, encodes a corresponding messenger RNA, VGAM233 host target RNA, herein designated VGAM HOST TARGET RNA. VGAM233 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM233 RNA, herein designated VGAM RNA, binds complementarily to one or more host target binding sites located in untranslated regions of VGAM233 host target RNA, herein designated VGAM HOST TARGET RNA. This complementary binding is due to the fact that the nucleotide sequence of VGAM233 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM233 RNA, herein designated VGAM RNA, may have a different number of host target binding sites in untranslated regions of a VGAM233 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM233 RNA, herein designated VGAM RNA, to host target binding sites on VGAM233 host target RNA, herein designated VGAM HOST TARGET RNA, such as BINDING SITE I, BINDING SITE II and BINDING SITE III, inhibits translation of VGAM233 host target RNA, herein designated VGAM HOST TARGET RNA, into VGAM233 host target protein, herein designated VGAM HOST TARGET PROTEIN. VGAM host target protein is therefore outlined by a broken line.

It is appreciated that VGAM233 host target gene, herein designated VGAM HOST TARGET GENE, in fact represents a plurality of VGAM233 host target genes. The mRNA of each one of this plurality of VGAM233 host target genes comprises one or more host target binding sites, each having a nucleotide sequence which is at least partly complementary to VGAM233 RNA, herein designated VGAM RNA, and which when bound by VGAM233 RNA, herein designated VGAM RNA, causes inhibition of translation of respective one or more VGAM233 host target proteins.

It is further appreciated by one skilled in the art that the mode of translational inhibition illustrated by FIG. 1 with specific reference to translational inhibition exerted by VGAM233 gene, herein designated VGAM GENE, on one or more VGAM233 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM233 is inhibition of expression of host target genes, as part of a novel viral mechanism of attacking a host. Accordingly, utilities of VGAM233 include diagnosis, prevention and treatment of viral infection by Vaccinia virus. Specific functions, and accordingly utilities, of VGAM233 correlate with, and may be deduced from, the identity of the host target genes which VGAM233 binds and inhibits, and the function of these host target genes, as elaborated hereinbelow.

Nucleotide sequences of the VGAM233 precursor RNA, herein designated VGAM PRECURSOR RNA, and of the diced VGAM233 RNA, herein designated VGAM RNA, and a schematic representation of the secondary folding of VGAM233 folded precursor RNA, herein designated VGAM FOLDED PRECURSOR RNA, of VGAM233 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM233 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 234 (VGAM234) viral gene, which modulates expression of respective host target genes thereof, the function and utility of which host target genes is known in the art.

VGAM234 is a novel bioinformatically detected regulatory, non protein coding, viral micro RNA (miRNA) gene. The method by which VGAM234 was detected is described hereinabove with reference to FIGS. 2-8.

VGAM234 gene, herein designated VGAM GENE, is a viral gene contained in the genome of Vaccinia virus. VGAM234 host target gene, herein designated VGAM HOST TARGET GENE, is a human gene contained in the human genome.

VGAM234 gene, herein designated VGAM GENE, encodes a VGAM234 precursor RNA, herein designated VGAM PRECURSOR RNA. Similar to other miRNA genes, and unlike most ordinary genes, VGAM234 precursor RNA, herein designated VGAM PRECURSOR RNA, does not encode a protein. A nucleotide sequence identical or highly similar to the nucleotide sequence of VGAM234 precursor RNA is designated SEQ ID:220, and is provided hereinbelow with reference to the sequence listing part. Nucleotide sequence SEQ ID:220 is located at position 123394 relative to the genome of Vaccinia virus.

VGAM234 precursor RNA, herein designated VGAM PRECURSOR RNA, folds onto itself, forming VGAM234 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM234 folded precursor RNA, herein designated VGAM FOLDED PRECURSOR RNA, into VGAM234 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 72%) nucleotide sequence of VGAM234 RNA is designated SEQ ID:569, and is provided hereinbelow with reference to the sequence listing part.

VGAM234 host target gene, herein designated VGAM HOST TARGET GENE, encodes a corresponding messenger RNA, VGAM234 host target RNA, herein designated VGAM HOST TARGET RNA. VGAM234 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM234 RNA, herein designated VGAM RNA, binds complementarily to one or more host target binding sites located in untranslated regions of VGAM234 host target RNA, herein designated VGAM HOST TARGET RNA. This complementary binding is due to the fact that the nucleotide sequence of VGAM234 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM234 RNA, herein designated VGAM RNA, may have a different number of host target binding sites in untranslated regions of a VGAM234 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM234 RNA, herein designated VGAM RNA, to host target binding sites on VGAM234 host target RNA, herein designated VGAM HOST TARGET RNA, such as BINDING SITE I, BINDING SITE II and BINDING SITE III, inhibits translation of VGAM234 host target RNA, herein designated VGAM HOST TARGET RNA, into VGAM234 host target protein, herein designated VGAM HOST TARGET PROTEIN. VGAM host target protein is therefore outlined by a broken line.

It is appreciated that VGAM234 host target gene, herein designated VGAM HOST TARGET GENE, in fact represents a plurality of VGAM234 host target genes. The mRNA of each one of this plurality of VGAM234 host target genes comprises one or more host target binding sites, each having a nucleotide sequence which is at least partly complementary to VGAM234 RNA, herein designated VGAM RNA, and which when bound by VGAM234 RNA, herein designated VGAM RNA, causes inhibition of translation of respective one or more VGAM234 host target proteins.

It is further appreciated by one skilled in the art that the mode of translational inhibition illustrated by FIG. 1 with specific reference to translational inhibition exerted by VGAM234 gene, herein designated VGAM GENE, on one or more VGAM234 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM234 is inhibition of expression of host target genes, as part of a novel viral mechanism of attacking a host. Accordingly, utilities of VGAM234 include diagnosis, prevention and treatment of viral infection by Vaccinia virus. Specific functions, and accordingly utilities, of VGAM234 correlate with, and may be deduced from, the identity of the host target genes which VGAM234 binds and inhibits, and the function of these host target genes, as elaborated hereinbelow.

Nucleotide sequences of the VGAM234 precursor RNA, herein designated VGAM PRECURSOR RNA, and of the diced VGAM234 RNA, herein designated VGAM RNA, and a schematic representation of the secondary folding of VGAM234 folded precursor RNA, herein designated VGAM FOLDED PRECURSOR RNA, of VGAM234 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM234 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 235 (VGAM235) viral gene, which modulates expression of respective host target genes thereof, the function and utility of which host target genes is known in the art.

VGAM235 is a novel bioinformatically detected regulatory, non protein coding, viral micro RNA (miRNA) gene. The method by which VGAM235 was detected is described hereinabove with reference to FIGS. 2-8.

VGAM235 gene, herein designated VGAM GENE, is a viral gene contained in the genome of Vaccinia virus. VGAM235 host target gene, herein designated VGAM HOST TARGET GENE, is a human gene contained in the human genome.

VGAM235 gene, herein designated VGAM GENE, encodes a VGAM235 precursor RNA, herein designated VGAM PRECURSOR RNA. Similar to other miRNA genes, and unlike most ordinary genes, VGAM235 precursor RNA, herein designated VGAM PRECURSOR RNA, does not encode a protein. A nucleotide sequence identical or highly similar to the nucleotide sequence of VGAM235 precursor RNA is designated SEQ ID:221, and is provided hereinbelow with reference to the sequence listing part. Nucleotide sequence SEQ ID:221 is located at position 123220 relative to the genome of Vaccinia virus.

VGAM235 precursor RNA, herein designated VGAM PRECURSOR RNA, folds onto itself, forming VGAM235 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM235 folded precursor RNA, herein designated VGAM FOLDED PRECURSOR RNA, into VGAM235 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM235 RNA is designated SEQ ID:570, and is provided hereinbelow with reference to the sequence listing part.

VGAM235 host target gene, herein designated VGAM HOST TARGET GENE, encodes a corresponding messenger RNA, VGAM235 host target RNA, herein designated VGAM HOST TARGET RNA. VGAM235 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM235 RNA, herein designated VGAM RNA, binds complementarily to one or more host target binding sites located in untranslated regions of VGAM235 host target RNA, herein designated VGAM HOST TARGET RNA. This complementary binding is due to the fact that the nucleotide sequence of VGAM235 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM235 RNA, herein designated VGAM RNA, may have a different number of host target binding sites in untranslated regions of a VGAM235 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM235 RNA, herein designated VGAM RNA, to host target binding sites on VGAM235 host target RNA, herein designated VGAM HOST TARGET RNA, such as BINDING SITE I, BINDING SITE II and BINDING SITE III, inhibits translation of VGAM235 host target RNA, herein designated VGAM HOST TARGET RNA, into VGAM235 host target protein, herein designated VGAM HOST TARGET PROTEIN. VGAM host target protein is therefore outlined by a broken line.

It is appreciated that VGAM235 host target gene, herein designated VGAM HOST TARGET GENE, in fact represents a plurality of VGAM235 host target genes. The mRNA of each one of this plurality of VGAM235 host target genes comprises one or more host target binding sites, each having a nucleotide sequence which is at least partly complementary to VGAM235 RNA, herein designated VGAM RNA, and which when bound by VGAM235 RNA, herein designated VGAM RNA, causes inhibition of translation of respective one or more VGAM235 host target proteins.

It is further appreciated by one skilled in the art that the mode of translational inhibition illustrated by FIG. 1 with specific reference to translational inhibition exerted by VGAM235 gene, herein designated VGAM GENE, on one or more VGAM235 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM235 is inhibition of expression of host target genes, as part of a novel viral mechanism of attacking a host. Accordingly, utilities of VGAM235 include diagnosis, prevention and treatment of viral infection by Vaccinia virus. Specific functions, and accordingly utilities, of VGAM235 correlate with, and may be deduced from, the identity of the host target genes which VGAM235 binds and inhibits, and the function of these host target genes, as elaborated hereinbelow.

Nucleotide sequences of the VGAM235 precursor RNA, herein designated VGAM PRECURSOR RNA, and of the diced VGAM235 RNA, herein designated VGAM RNA, and a schematic representation of the secondary folding of VGAM235 folded precursor RNA, herein designated VGAM FOLDED PRECURSOR RNA, of VGAM235 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM235 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 236 (VGAM236) viral gene, which modulates expression of respective host target genes thereof, the function and utility of which host target genes is known in the art.

VGAM236 is a novel bioinformatically detected regulatory, non protein coding, viral micro RNA (miRNA) gene. The method by which VGAM236 was detected is described hereinabove with reference to FIGS. 2-8.

VGAM236 gene, herein designated VGAM GENE, is a viral gene contained in the genome of Vaccinia virus. VGAM236 host target gene, herein designated VGAM HOST TARGET GENE, is a human gene contained in the human genome.

VGAM236 gene, herein designated VGAM GENE, encodes a VGAM236 precursor RNA, herein designated VGAM PRECURSOR RNA. Similar to other miRNA genes, and unlike most ordinary genes, VGAM236 precursor RNA, herein designated VGAM PRECURSOR RNA, does not encode a protein. A nucleotide sequence identical or highly similar to the nucleotide sequence of VGAM236 precursor RNA is designated SEQ ID:222, and is provided hereinbelow with reference to the sequence listing part. Nucleotide sequence SEQ ID:222 is located at position 124655 relative to the genome of Vaccinia virus.

VGAM236 precursor RNA, herein designated VGAM PRECURSOR RNA, folds onto itself, forming VGAM236 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM236 folded precursor RNA, herein designated VGAM FOLDED PRECURSOR RNA, into VGAM236 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 77%) nucleotide sequence of VGAM236 RNA is designated SEQ ID:571, and is provided hereinbelow with reference to the sequence listing part.

VGAM236 host target gene, herein designated VGAM HOST TARGET GENE, encodes a corresponding messenger RNA, VGAM236 host target RNA, herein designated VGAM HOST TARGET RNA. VGAM236 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM236 RNA, herein designated VGAM RNA, binds complementarily to one or more host target binding sites located in untranslated regions of VGAM236 host target RNA, herein designated VGAM HOST TARGET RNA. This complementary binding is due to the fact that the nucleotide sequence of VGAM236 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM236 RNA, herein designated VGAM RNA, may have a different number of host target binding sites in untranslated regions of a VGAM236 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM236 RNA, herein designated VGAM RNA, to host target binding sites on VGAM236 host target RNA, herein designated VGAM HOST TARGET RNA, such as BINDING SITE I, BINDING SITE II and BINDING SITE III, inhibits translation of VGAM236 host target RNA, herein designated VGAM HOST TARGET RNA, into VGAM236 host target protein, herein designated VGAM HOST TARGET PROTEIN. VGAM host target protein is therefore outlined by a broken line.

It is appreciated that VGAM236 host target gene, herein designated VGAM HOST TARGET GENE, in fact represents a plurality of VGAM236 host target genes. The mRNA of each one of this plurality of VGAM236 host target genes comprises one or more host target binding sites, each having a nucleotide sequence which is at least partly complementary to VGAM236 RNA, herein designated VGAM RNA, and which when bound by VGAM236 RNA, herein designated VGAM RNA, causes inhibition of translation of respective one or more VGAM236 host target proteins.

It is further appreciated by one skilled in the art that the mode of translational inhibition illustrated by FIG. 1 with specific reference to translational inhibition exerted by VGAM236 gene, herein designated VGAM GENE, on one or more VGAM236 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM236 is inhibition of expression of host target genes, as part of a novel viral mechanism of attacking a host. Accordingly, utilities of VGAM236 include diagnosis, prevention and treatment of viral infection by Vaccinia virus. Specific functions, and accordingly utilities, of VGAM236 correlate with, and may be deduced from, the identity of the host target genes which VGAM236 binds and inhibits, and the function of these host target genes, as elaborated hereinbelow.

Nucleotide sequences of the VGAM236 precursor RNA, herein designated VGAM PRECURSOR RNA, and of the diced VGAM236 RNA, herein designated VGAM RNA, and a schematic representation of the secondary folding of VGAM236 folded precursor RNA, herein designated VGAM FOLDED PRECURSOR RNA, of VGAM236 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM236 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 237 (VGAM237) viral gene, which modulates expression of respective host target genes thereof, the function and utility of which host target genes is known in the art.

VGAM237 is a novel bioinformatically detected regulatory, non protein coding, viral micro RNA (miRNA) gene. The method by which VGAM237 was detected is described hereinabove with reference to FIGS. 2-8.

VGAM237 gene, herein designated VGAM GENE, is a viral gene contained in the genome of Vaccinia virus. VGAM237 host target gene, herein designated VGAM HOST TARGET GENE, is a human gene contained in the human genome.

VGAM237 gene, herein designated VGAM GENE, encodes a VGAM237 precursor RNA, herein designated VGAM PRECURSOR RNA. Similar to other miRNA genes, and unlike most ordinary genes, VGAM237 precursor RNA, herein designated VGAM PRECURSOR RNA, does not encode a protein. A nucleotide sequence identical or highly similar to the nucleotide sequence of VGAM237 precursor RNA is designated SEQ ID:223, and is provided hereinbelow with reference to the sequence listing part. Nucleotide sequence SEQ ID:223 is located at position 127745 relative to the genome of Vaccinia virus.

VGAM237 precursor RNA, herein designated VGAM PRECURSOR RNA, folds onto itself, forming VGAM237 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM237 folded precursor RNA, herein designated VGAM FOLDED PRECURSOR RNA, into VGAM237 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM237 RNA is designated SEQ ID:572, and is provided hereinbelow with reference to the sequence listing part.

VGAM237 host target gene, herein designated VGAM HOST TARGET GENE, encodes a corresponding messenger RNA, VGAM237 host target RNA, herein designated VGAM HOST TARGET RNA. VGAM237 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM237 RNA, herein designated VGAM RNA, binds complementarily to one or more host target binding sites located in untranslated regions of VGAM237 host target RNA, herein designated VGAM HOST TARGET RNA. This complementary binding is due to the fact that the nucleotide sequence of VGAM237 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM237 RNA, herein designated VGAM RNA, may have a different number of host target binding sites in untranslated regions of a VGAM237 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM237 RNA, herein designated VGAM RNA, to host target binding sites on VGAM237 host target RNA, herein designated VGAM HOST TARGET RNA, such as BINDING SITE I, BINDING SITE II and BINDING SITE III, inhibits translation of VGAM237 host target RNA, herein designated VGAM HOST TARGET RNA, into VGAM237 host target protein, herein designated VGAM HOST TARGET PROTEIN. VGAM host target protein is therefore outlined by a broken line.

It is appreciated that VGAM237 host target gene, herein designated VGAM HOST TARGET GENE, in fact represents a plurality of VGAM237 host target genes. The mRNA of each one of this plurality of VGAM237 host target genes comprises one or more host target binding sites, each having a nucleotide sequence which is at least partly complementary to VGAM237 RNA, herein designated VGAM RNA, and which when bound by VGAM237 RNA, herein designated VGAM RNA, causes inhibition of translation of respective one or more VGAM237 host target proteins.

It is further appreciated by one skilled in the art that the mode of translational inhibition illustrated by FIG. 1 with specific reference to translational inhibition exerted by VGAM237 gene, herein designated VGAM GENE, on one or more VGAM237 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM237 is inhibition of expression of host target genes, as part of a novel viral mechanism of attacking a host. Accordingly, utilities of VGAM237 include diagnosis, prevention and treatment of viral infection by Vaccinia virus. Specific functions, and accordingly utilities, of VGAM237 correlate with, and may be deduced from, the identity of the host target genes which VGAM237 binds and inhibits, and the function of these host target genes, as elaborated hereinbelow.

Nucleotide sequences of the VGAM237 precursor RNA, herein designated VGAM PRECURSOR RNA, and of the diced VGAM237 RNA, herein designated VGAM RNA, and a schematic representation of the secondary folding of VGAM237 folded precursor RNA, herein designated VGAM FOLDED PRECURSOR RNA, of VGAM237 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM237 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 238 (VGAM238) viral gene, which modulates expression of respective host target genes thereof, the function and utility of which host target genes is known in the art.

VGAM238 is a novel bioinformatically detected regulatory, non protein coding, viral micro RNA (miRNA) gene. The method by which VGAM238 was detected is described hereinabove with reference to FIGS. 2-8.

VGAM238 gene, herein designated VGAM GENE, is a viral gene contained in the genome of Vaccinia virus. VGAM238 host target gene, herein designated VGAM HOST TARGET GENE, is a human gene contained in the human genome.

VGAM238 gene, herein designated VGAM GENE, encodes a VGAM238 precursor RNA, herein designated VGAM PRECURSOR RNA. Similar to other miRNA genes, and unlike most ordinary genes, VGAM238 precursor RNA, herein designated VGAM PRECURSOR RNA, does not encode a protein. A nucleotide sequence identical or highly similar to the nucleotide sequence of VGAM238 precursor RNA is designated SEQ ID:224, and is provided hereinbelow with reference to the sequence listing part. Nucleotide sequence SEQ ID:224 is located at position 126291 relative to the genome of Vaccinia virus.

VGAM238 precursor RNA, herein designated VGAM PRECURSOR RNA, folds onto itself, forming VGAM238 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM238 folded precursor RNA, herein designated VGAM FOLDED PRECURSOR RNA, into VGAM238 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 85%) nucleotide sequence of VGAM238 RNA is designated SEQ ID:573, and is provided hereinbelow with reference to the sequence listing part.

VGAM238 host target gene, herein designated VGAM HOST TARGET GENE, encodes a corresponding messenger RNA, VGAM238 host target RNA, herein designated VGAM HOST TARGET RNA. VGAM238 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM238 RNA, herein designated VGAM RNA, binds complementarily to one or more host target binding sites located in untranslated regions of VGAM238 host target RNA, herein designated VGAM HOST TARGET RNA. This complementary binding is due to the fact that the nucleotide sequence of VGAM238 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM238 RNA, herein designated VGAM RNA, may have a different number of host target binding sites in untranslated regions of a VGAM238 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM238 RNA, herein designated VGAM RNA, to host target binding sites on VGAM238 host target RNA, herein designated VGAM HOST TARGET RNA, such as BINDING SITE I, BINDING SITE II and BINDING SITE III, inhibits translation of VGAM238 host target RNA, herein designated VGAM HOST TARGET RNA, into VGAM238 host target protein, herein designated VGAM HOST TARGET PROTEIN. VGAM host target protein is therefore outlined by a broken line.

It is appreciated that VGAM238 host target gene, herein designated VGAM HOST TARGET GENE, in fact represents a plurality of VGAM238 host target genes. The mRNA of each one of this plurality of VGAM238 host target genes comprises one or more host target binding sites, each having a nucleotide sequence which is at least partly complementary to VGAM238 RNA, herein designated VGAM RNA, and which when bound by VGAM238 RNA, herein designated VGAM RNA, causes inhibition of translation of respective one or more VGAM238 host target proteins.

It is further appreciated by one skilled in the art that the mode of translational inhibition illustrated by FIG. 1 with specific reference to translational inhibition exerted by VGAM238 gene, herein designated VGAM GENE, on one or more VGAM238 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM238 is inhibition of expression of host target genes, as part of a novel viral mechanism of attacking a host. Accordingly, utilities of VGAM238 include diagnosis, prevention and treatment of viral infection by Vaccinia virus. Specific functions, and accordingly utilities, of VGAM238 correlate with, and may be deduced from, the identity of the host target genes which VGAM238 binds and inhibits, and the function of these host target genes, as elaborated hereinbelow.

Nucleotide sequences of the VGAM238 precursor RNA, herein designated VGAM PRECURSOR RNA, and of the diced VGAM238 RNA, herein designated VGAM RNA, and a schematic representation of the secondary folding of VGAM238 folded precursor RNA, herein designated VGAM FOLDED PRECURSOR RNA, of VGAM238 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM238 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 239 (VGAM239) viral gene, which modulates expression of respective host target genes thereof, the function and utility of which host target genes is known in the art.

VGAM239 is a novel bioinformatically detected regulatory, non protein coding, viral micro RNA (miRNA) gene. The method by which VGAM239 was detected is described hereinabove with reference to FIGS. 2-8.

VGAM239 gene, herein designated VGAM GENE, is a viral gene contained in the genome of Vaccinia virus. VGAM239 host target gene, herein designated VGAM HOST TARGET GENE, is a human gene contained in the human genome.

VGAM239 gene, herein designated VGAM GENE, encodes a VGAM239 precursor RNA, herein designated VGAM PRECURSOR RNA. Similar to other miRNA genes, and unlike most ordinary genes, VGAM239 precursor RNA, herein designated VGAM PRECURSOR RNA, does not encode a protein. A nucleotide sequence identical or highly similar to the nucleotide sequence of VGAM239 precursor RNA is designated SEQ ID:225, and is provided hereinbelow with reference to the sequence listing part. Nucleotide sequence SEQ ID:225 is located at position 127132 relative to the genome of Vaccinia virus.

VGAM239 precursor RNA, herein designated VGAM PRECURSOR RNA, folds onto itself, forming VGAM239 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM239 folded precursor RNA, herein designated VGAM FOLDED PRECURSOR RNA, into VGAM239 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 89%) nucleotide sequence of VGAM239 RNA is designated SEQ ID:574, and is provided hereinbelow with reference to the sequence listing part.

VGAM239 host target gene, herein designated VGAM HOST TARGET GENE, encodes a corresponding messenger RNA, VGAM239 host target RNA, herein designated VGAM HOST TARGET RNA. VGAM239 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM239 RNA, herein designated VGAM RNA, binds complementarily to one or more host target binding sites located in untranslated regions of VGAM239 host target RNA, herein designated VGAM HOST TARGET RNA. This complementary binding is due to the fact that the nucleotide sequence of VGAM239 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM239 RNA, herein designated VGAM RNA, may have a different number of host target binding sites in untranslated regions of a VGAM239 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM239 RNA, herein designated VGAM RNA, to host target binding sites on VGAM239 host target RNA, herein designated VGAM HOST TARGET RNA, such as BINDING SITE I, BINDING SITE II and BINDING SITE III, inhibits translation of VGAM239 host target RNA, herein designated VGAM HOST TARGET RNA, into VGAM239 host target protein, herein designated VGAM HOST TARGET PROTEIN. VGAM host target protein is therefore outlined by a broken line.

It is appreciated that VGAM239 host target gene, herein designated VGAM HOST TARGET GENE, in fact represents a plurality of VGAM239 host target genes. The mRNA of each one of this plurality of VGAM239 host target genes comprises one or more host target binding sites, each having a nucleotide sequence which is at least partly complementary to VGAM239 RNA, herein designated VGAM RNA, and which when bound by VGAM239 RNA, herein designated VGAM RNA, causes inhibition of translation of respective one or more VGAM239 host target proteins.

It is further appreciated by one skilled in the art that the mode of translational inhibition illustrated by FIG. 1 with specific reference to translational inhibition exerted by VGAM239 gene, herein designated VGAM GENE, on one or more VGAM239 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM239 is inhibition of expression of host target genes, as part of a novel viral mechanism of attacking a host. Accordingly, utilities of VGAM239 include diagnosis, prevention and treatment of viral infection by Vaccinia virus. Specific functions, and accordingly utilities, of VGAM239 correlate with, and may be deduced from, the identity of the host target genes which VGAM239 binds and inhibits, and the function of these host target genes, as elaborated hereinbelow.

Nucleotide sequences of the VGAM239 precursor RNA, herein designated VGAM PRECURSOR RNA, and of the diced VGAM239 RNA, herein designated VGAM RNA, and a schematic representation of the secondary folding of VGAM239 folded precursor RNA, herein designated VGAM FOLDED PRECURSOR RNA, of VGAM239 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM239 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 240 (VGAM240) viral gene, which modulates expression of respective host target genes thereof, the function and utility of which host target genes is known in the art.

VGAM240 is a novel bioinformatically detected regulatory, non protein coding, viral micro RNA (miRNA) gene. The method by which VGAM240 was detected is described hereinabove with reference to FIGS. 2-8.

VGAM240 gene, herein designated VGAM GENE, is a viral gene contained in the genome of Vaccinia virus. VGAM240 host target gene, herein designated VGAM HOST TARGET GENE, is a human gene contained in the human genome.

VGAM240 gene, herein designated VGAM GENE, encodes a VGAM240 precursor RNA, herein designated VGAM PRECURSOR RNA. Similar to other miRNA genes, and unlike most ordinary genes, VGAM240 precursor RNA, herein designated VGAM PRECURSOR RNA, does not encode a protein. A nucleotide sequence identical or highly similar to the nucleotide sequence of VGAM240 precursor RNA is designated SEQ ID:226, and is provided hereinbelow with reference to the sequence listing part. Nucleotide sequence SEQ ID:226 is located at position 129602 relative to the genome of Vaccinia virus.

VGAM240 precursor RNA, herein designated VGAM PRECURSOR RNA, folds onto itself, forming VGAM240 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM240 folded precursor RNA, herein designated VGAM FOLDED PRECURSOR RNA, into VGAM240 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM240 RNA is designated SEQ ID:575, and is provided hereinbelow with reference to the sequence listing part.

VGAM240 host target gene, herein designated VGAM HOST TARGET GENE, encodes a corresponding messenger RNA, VGAM240 host target RNA, herein designated VGAM HOST TARGET RNA. VGAM240 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM240 RNA, herein designated VGAM RNA, binds complementarily to one or more host target binding sites located in untranslated regions of VGAM240 host target RNA, herein designated VGAM HOST TARGET RNA. This complementary binding is due to the fact that the nucleotide sequence of VGAM240 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM240 RNA, herein designated VGAM RNA, may have a different number of host target binding sites in untranslated regions of a VGAM240 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM240 RNA, herein designated VGAM RNA, to host target binding sites on VGAM240 host target RNA, herein designated VGAM HOST TARGET RNA, such as BINDING SITE I, BINDING SITE II and BINDING SITE III, inhibits translation of VGAM240 host target RNA, herein designated VGAM HOST TARGET RNA, into VGAM240 host target protein, herein designated VGAM HOST TARGET PROTEIN. VGAM host target protein is therefore outlined by a broken line.

It is appreciated that VGAM240 host target gene, herein designated VGAM HOST TARGET GENE, in fact represents a plurality of VGAM240 host target genes. The mRNA of each one of this plurality of VGAM240 host target genes comprises one or more host target binding sites, each having a nucleotide sequence which is at least partly complementary to VGAM240 RNA, herein designated VGAM RNA, and which when bound by VGAM240 RNA, herein designated VGAM RNA, causes inhibition of translation of respective one or more VGAM240 host target proteins.

It is further appreciated by one skilled in the art that the mode of translational inhibition illustrated by FIG. 1 with specific reference to translational inhibition exerted by VGAM240 gene, herein designated VGAM GENE, on one or more VGAM240 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM240 is inhibition of expression of host target genes, as part of a novel viral mechanism of attacking a host. Accordingly, utilities of VGAM240 include diagnosis, prevention and treatment of viral infection by Vaccinia virus. Specific functions, and accordingly utilities, of VGAM240 correlate with, and may be deduced from, the identity of the host target genes which VGAM240 binds and inhibits, and the function of these host target genes, as elaborated hereinbelow.

Nucleotide sequences of the VGAM240 precursor RNA, herein designated VGAM PRECURSOR RNA, and of the diced VGAM240 RNA, herein designated VGAM RNA, and a schematic representation of the secondary folding of VGAM240 folded precursor RNA, herein designated VGAM FOLDED PRECURSOR RNA, of VGAM240 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM240 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 241 (VGAM241) viral gene, which modulates expression of respective host target genes thereof, the function and utility of which host target genes is known in the art.

VGAM241 is a novel bioinformatically detected regulatory, non protein coding, viral micro RNA (miRNA) gene. The method by which VGAM241 was detected is described hereinabove with reference to FIGS. 2-8.

VGAM241 gene, herein designated VGAM GENE, is a viral gene contained in the genome of Vaccinia virus. VGAM241 host target gene, herein designated VGAM HOST TARGET GENE, is a human gene contained in the human genome.

VGAM241 gene, herein designated VGAM GENE, encodes a VGAM241 precursor RNA, herein designated VGAM PRECURSOR RNA. Similar to other miRNA genes, and unlike most ordinary genes, VGAM241 precursor RNA, herein designated VGAM PRECURSOR RNA, does not encode a protein. A nucleotide sequence identical or highly similar to the nucleotide sequence of VGAM241 precursor RNA is designated SEQ ID:227, and is provided hereinbelow with reference to the sequence listing part. Nucleotide sequence SEQ ID:227 is located at position 130612 relative to the genome of Vaccinia virus.

VGAM241 precursor RNA, herein designated VGAM PRECURSOR RNA, folds onto itself, forming VGAM241 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM241 folded precursor RNA, herein designated VGAM FOLDED PRECURSOR RNA, into VGAM241 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM241 RNA is designated SEQ ID:576, and is provided hereinbelow with reference to the sequence listing part.

VGAM241 host target gene, herein designated VGAM HOST TARGET GENE, encodes a corresponding messenger RNA, VGAM241 host target RNA, herein designated VGAM HOST TARGET RNA. VGAM241 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM241 RNA, herein designated VGAM RNA, binds complementarily to one or more host target binding sites located in untranslated regions of VGAM241 host target RNA, herein designated VGAM HOST TARGET RNA. This complementary binding is due to the fact that the nucleotide sequence of VGAM241 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM241 RNA, herein designated VGAM RNA, may have a different number of host target binding sites in untranslated regions of a VGAM241 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM241 RNA, herein designated VGAM RNA, to host target binding sites on VGAM241 host target RNA, herein designated VGAM HOST TARGET RNA, such as BINDING SITE I, BINDING SITE II and BINDING SITE III, inhibits translation of VGAM241 host target RNA, herein designated VGAM HOST TARGET RNA, into VGAM241 host target protein, herein designated VGAM HOST TARGET PROTEIN. VGAM host target protein is therefore outlined by a broken line.

It is appreciated that VGAM241 host target gene, herein designated VGAM HOST TARGET GENE, in fact represents a plurality of VGAM241 host target genes. The mRNA of each one of this plurality of VGAM241 host target genes comprises one or more host target binding sites, each having a nucleotide sequence which is at least partly complementary to VGAM241 RNA, herein designated VGAM RNA, and which when bound by VGAM241 RNA, herein designated VGAM RNA, causes inhibition of translation of respective one or more VGAM241 host target proteins.

It is further appreciated by one skilled in the art that the mode of translational inhibition illustrated by FIG. 1 with specific reference to translational inhibition exerted by VGAM241 gene, herein designated VGAM GENE, on one or more VGAM241 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM241 is inhibition of expression of host target genes, as part of a novel viral mechanism of attacking a host. Accordingly, utilities of VGAM241 include diagnosis, prevention and treatment of viral infection by Vaccinia virus. Specific functions, and accordingly utilities, of VGAM241 correlate with, and may be deduced from, the identity of the host target genes which VGAM241 binds and inhibits, and the function of these host target genes, as elaborated hereinbelow.

Nucleotide sequences of the VGAM241 precursor RNA, herein designated VGAM PRECURSOR RNA, and of the diced VGAM241 RNA, herein designated VGAM RNA, and a schematic representation of the secondary folding of VGAM241 folded precursor RNA, herein designated VGAM FOLDED PRECURSOR RNA, of VGAM241 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM241 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 242 (VGAM242) viral gene, which modulates expression of respective host target genes thereof, the function and utility of which host target genes is known in the art.

VGAM242 is a novel bioinformatically detected regulatory, non protein coding, viral micro RNA (miRNA) gene. The method by which VGAM242 was detected is described hereinabove with reference to FIGS. 2-8.

VGAM242 gene, herein designated VGAM GENE, is a viral gene contained in the genome of Vaccinia virus. VGAM242 host target gene, herein designated VGAM HOST TARGET GENE, is a human gene contained in the human genome.

VGAM242 gene, herein designated VGAM GENE, encodes a VGAM242 precursor RNA, herein designated VGAM PRECURSOR RNA. Similar to other miRNA genes, and unlike most ordinary genes, VGAM242 precursor RNA, herein designated VGAM PRECURSOR RNA, does not encode a protein. A nucleotide sequence identical or highly similar to the nucleotide sequence of VGAM242 precursor RNA is designated SEQ ID:228, and is provided hereinbelow with reference to the sequence listing part. Nucleotide sequence SEQ ID:228 is located at position 131407 relative to the genome of Vaccinia virus.

VGAM242 precursor RNA, herein designated VGAM PRECURSOR RNA, folds onto itself, forming VGAM242 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM242 folded precursor RNA, herein designated VGAM FOLDED PRECURSOR RNA, into VGAM242 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM242 RNA is designated SEQ ID:577, and is provided hereinbelow with reference to the sequence listing part.

VGAM242 host target gene, herein designated VGAM HOST TARGET GENE, encodes a corresponding messenger RNA, VGAM242 host target RNA, herein designated VGAM HOST TARGET RNA. VGAM242 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM242 RNA, herein designated VGAM RNA, binds complementarily to one or more host target binding sites located in untranslated regions of VGAM242 host target RNA, herein designated VGAM HOST TARGET RNA. This complementary binding is due to the fact that the nucleotide sequence of VGAM242 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM242 RNA, herein designated VGAM RNA, may have a different number of host target binding sites in untranslated regions of a VGAM242 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM242 RNA, herein designated VGAM RNA, to host target binding sites on VGAM242 host target RNA, herein designated VGAM HOST TARGET RNA, such as BINDING SITE I, BINDING SITE II and BINDING SITE III, inhibits translation of VGAM242 host target RNA, herein designated VGAM HOST TARGET RNA, into VGAM242 host target protein, herein designated VGAM HOST TARGET PROTEIN. VGAM host target protein is therefore outlined by a broken line.

It is appreciated that VGAM242 host target gene, herein designated VGAM HOST TARGET GENE, in fact represents a plurality of VGAM242 host target genes. The mRNA of each one of this plurality of VGAM242 host target genes comprises one or more host target binding sites, each having a nucleotide sequence which is at least partly complementary to VGAM242 RNA, herein designated VGAM RNA, and which when bound by VGAM242 RNA, herein designated VGAM RNA, causes inhibition of translation of respective one or more VGAM242 host target proteins.

It is further appreciated by one skilled in the art that the mode of translational inhibition illustrated by FIG. 1 with specific reference to translational inhibition exerted by VGAM242 gene, herein designated VGAM GENE, on one or more VGAM242 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM242 is inhibition of expression of host target genes, as part of a novel viral mechanism of attacking a host. Accordingly, utilities of VGAM242 include diagnosis, prevention and treatment of viral infection by Vaccinia virus. Specific functions, and accordingly utilities, of VGAM242 correlate with, and may be deduced from, the identity of the host target genes which VGAM242 binds and inhibits, and the function of these host target genes, as elaborated hereinbelow.

Nucleotide sequences of the VGAM242 precursor RNA, herein designated VGAM PRECURSOR RNA, and of the diced VGAM242 RNA, herein designated VGAM RNA, and a schematic representation of the secondary folding of VGAM242 folded precursor RNA, herein designated VGAM FOLDED PRECURSOR RNA, of VGAM242 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM242 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 243 (VGAM243) viral gene, which modulates expression of respective host target genes thereof, the function and utility of which host target genes is known in the art.

VGAM243 is a novel bioinformatically detected regulatory, non protein coding, viral micro RNA (miRNA) gene. The method by which VGAM243 was detected is described hereinabove with reference to FIGS. 2-8.

VGAM243 gene, herein designated VGAM GENE, is a viral gene contained in the genome of Vaccinia virus. VGAM243 host target gene, herein designated VGAM HOST TARGET GENE, is a human gene contained in the human genome.

VGAM243 gene, herein designated VGAM GENE, encodes a VGAM243 precursor RNA, herein designated VGAM PRECURSOR RNA. Similar to other miRNA genes, and unlike most ordinary genes, VGAM243 precursor RNA, herein designated VGAM PRECURSOR RNA, does not encode a protein. A nucleotide sequence identical or highly similar to the nucleotide sequence of VGAM243 precursor RNA is designated SEQ ID:229, and is provided hereinbelow with reference to the sequence listing part. Nucleotide sequence SEQ ID:229 is located at position 135663 relative to the genome of Vaccinia virus.

VGAM243 precursor RNA, herein designated VGAM PRECURSOR RNA, folds onto itself, forming VGAM243 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM243 folded precursor RNA, herein designated VGAM FOLDED PRECURSOR RNA, into VGAM243 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 77%) nucleotide sequence of VGAM243 RNA is designated SEQ ID:578, and is provided hereinbelow with reference to the sequence listing part.

VGAM243 host target gene, herein designated VGAM HOST TARGET GENE, encodes a corresponding messenger RNA, VGAM243 host target RNA, herein designated VGAM HOST TARGET RNA. VGAM243 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM243 RNA, herein designated VGAM RNA, binds complementarily to one or more host target binding sites located in untranslated regions of VGAM243 host target RNA, herein designated VGAM HOST TARGET RNA. This complementary binding is due to the fact that the nucleotide sequence of VGAM243 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM243 RNA, herein designated VGAM RNA, may have a different number of host target binding sites in untranslated regions of a VGAM243 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM243 RNA, herein designated VGAM RNA, to host target binding sites on VGAM243 host target RNA, herein designated VGAM HOST TARGET RNA, such as BINDING SITE I, BINDING SITE II and BINDING SITE III, inhibits translation of VGAM243 host target RNA, herein designated VGAM HOST TARGET RNA, into VGAM243 host target protein, herein designated VGAM HOST TARGET PROTEIN. VGAM host target protein is therefore outlined by a broken line.

It is appreciated that VGAM243 host target gene, herein designated VGAM HOST TARGET GENE, in fact represents a plurality of VGAM243 host target genes. The mRNA of each one of this plurality of VGAM243 host target genes comprises one or more host target binding sites, each having a nucleotide sequence which is at least partly complementary to VGAM243 RNA, herein designated VGAM RNA, and which when bound by VGAM243 RNA, herein designated VGAM RNA, causes inhibition of translation of respective one or more VGAM243 host target proteins.

It is further appreciated by one skilled in the art that the mode of translational inhibition illustrated by FIG. 1 with specific reference to translational inhibition exerted by VGAM243 gene, herein designated VGAM GENE, on one or more VGAM243 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM243 is inhibition of expression of host target genes, as part of a novel viral mechanism of attacking a host. Accordingly, utilities of VGAM243 include diagnosis, prevention and treatment of viral infection by Vaccinia virus. Specific functions, and accordingly utilities, of VGAM243 correlate with, and may be deduced from, the identity of the host target genes which VGAM243 binds and inhibits, and the function of these host target genes, as elaborated hereinbelow.

Nucleotide sequences of the VGAM243 precursor RNA, herein designated VGAM PRECURSOR RNA, and of the diced VGAM243 RNA, herein designated VGAM RNA, and a schematic representation of the secondary folding of VGAM243 folded precursor RNA, herein designated VGAM FOLDED PRECURSOR RNA, of VGAM243 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM243 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 244 (VGAM244) viral gene, which modulates expression of respective host target genes thereof, the function and utility of which host target genes is known in the art.

VGAM244 is a novel bioinformatically detected regulatory, non protein coding, viral micro RNA (miRNA) gene. The method by which VGAM244 was detected is described hereinabove with reference to FIGS. 2-8.

VGAM244 gene, herein designated VGAM GENE, is a viral gene contained in the genome of Vaccinia virus. VGAM244 host target gene, herein designated VGAM HOST TARGET GENE, is a human gene contained in the human genome.

VGAM244 gene, herein designated VGAM GENE, encodes a VGAM244 precursor RNA, herein designated VGAM PRECURSOR RNA. Similar to other miRNA genes, and unlike most ordinary genes, VGAM244 precursor RNA, herein designated VGAM PRECURSOR RNA, does not encode a protein. A nucleotide sequence identical or highly similar to the nucleotide sequence of VGAM244 precursor RNA is designated SEQ ID:230, and is provided hereinbelow with reference to the sequence listing part. Nucleotide sequence SEQ ID:230 is located at position 134932 relative to the genome of Vaccinia virus.

VGAM244 precursor RNA, herein designated VGAM PRECURSOR RNA, folds onto itself, forming VGAM244 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM244 folded precursor RNA, herein designated VGAM FOLDED PRECURSOR RNA, into VGAM244 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 91%) nucleotide sequence of VGAM244 RNA is designated SEQ ID:579, and is provided hereinbelow with reference to the sequence listing part.

VGAM244 host target gene, herein designated VGAM HOST TARGET GENE, encodes a corresponding messenger RNA, VGAM244 host target RNA, herein designated VGAM HOST TARGET RNA. VGAM244 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM244 RNA, herein designated VGAM RNA, binds complementarily to one or more host target binding sites located in untranslated regions of VGAM244 host target RNA, herein designated VGAM HOST TARGET RNA. This complementary binding is due to the fact that the nucleotide sequence of VGAM244 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM244 RNA, herein designated VGAM RNA, may have a different number of host target binding sites in untranslated regions of a VGAM244 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM244 RNA, herein designated VGAM RNA, to host target binding sites on VGAM244 host target RNA, herein designated VGAM HOST TARGET RNA, such as BINDING SITE I, BINDING SITE II and BINDING SITE III, inhibits translation of VGAM244 host target RNA, herein designated VGAM HOST TARGET RNA, into VGAM244 host target protein, herein designated VGAM HOST TARGET PROTEIN. VGAM host target protein is therefore outlined by a broken line.

It is appreciated that VGAM244 host target gene, herein designated VGAM HOST TARGET GENE, in fact represents a plurality of VGAM244 host target genes. The mRNA of each one of this plurality of VGAM244 host target genes comprises one or more host target binding sites, each having a nucleotide sequence which is at least partly complementary to VGAM244 RNA, herein designated VGAM RNA, and which when bound by VGAM244 RNA, herein designated VGAM RNA, causes inhibition of translation of respective one or more VGAM244 host target proteins.

It is further appreciated by one skilled in the art that the mode of translational inhibition illustrated by FIG. 1 with specific reference to translational inhibition exerted by VGAM244 gene, herein designated VGAM GENE, on one or more VGAM244 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM244 is inhibition of expression of host target genes, as part of a novel viral mechanism of attacking a host. Accordingly, utilities of VGAM244 include diagnosis, prevention and treatment of viral infection by Vaccinia virus. Specific functions, and accordingly utilities, of VGAM244 correlate with, and may be deduced from, the identity of the host target genes which VGAM244 binds and inhibits, and the function of these host target genes, as elaborated hereinbelow.

Nucleotide sequences of the VGAM244 precursor RNA, herein designated VGAM PRECURSOR RNA, and of the diced VGAM244 RNA, herein designated VGAM RNA, and a schematic representation of the secondary folding of VGAM244 folded precursor RNA, herein designated VGAM FOLDED PRECURSOR RNA, of VGAM244 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM244 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 245 (VGAM245) viral gene, which modulates expression of respective host target genes thereof, the function and utility of which host target genes is known in the art.

VGAM245 is a novel bioinformatically detected regulatory, non protein coding, viral micro RNA (miRNA) gene. The method by which VGAM245 was detected is described hereinabove with reference to FIGS. 2-8.

VGAM245 gene, herein designated VGAM GENE, is a viral gene contained in the genome of Vaccinia virus. VGAM245 host target gene, herein designated VGAM HOST TARGET GENE, is a human gene contained in the human genome.

VGAM245 gene, herein designated VGAM GENE, encodes a VGAM245 precursor RNA, herein designated VGAM PRECURSOR RNA. Similar to other miRNA genes, and unlike most ordinary genes, VGAM245 precursor RNA, herein designated VGAM PRECURSOR RNA, does not encode a protein. A nucleotide sequence identical or highly similar to the nucleotide sequence of VGAM245 precursor RNA is designated SEQ ID:231, and is provided hereinbelow with reference to the sequence listing part. Nucleotide sequence SEQ ID:231 is located at position 133924 relative to the genome of Vaccinia virus.

VGAM245 precursor RNA, herein designated VGAM PRECURSOR RNA, folds onto itself, forming VGAM245 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM245 folded precursor RNA, herein designated VGAM FOLDED PRECURSOR RNA, into VGAM245 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 87%) nucleotide sequence of VGAM245 RNA is designated SEQ ID:580, and is provided hereinbelow with reference to the sequence listing part.

VGAM245 host target gene, herein designated VGAM HOST TARGET GENE, encodes a corresponding messenger RNA, VGAM245 host target RNA, herein designated VGAM HOST TARGET RNA. VGAM245 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM245 RNA, herein designated VGAM RNA, binds complementarily to one or more host target binding sites located in untranslated regions of VGAM245 host target RNA, herein designated VGAM HOST TARGET RNA. This complementary binding is due to the fact that the nucleotide sequence of VGAM245 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM245 RNA, herein designated VGAM RNA, may have a different number of host target binding sites in untranslated regions of a VGAM245 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM245 RNA, herein designated VGAM RNA, to host target binding sites on VGAM245 host target RNA, herein designated VGAM HOST TARGET RNA, such as BINDING SITE I, BINDING SITE II and BINDING SITE III, inhibits translation of VGAM245 host target RNA, herein designated VGAM HOST TARGET RNA, into VGAM245 host target protein, herein designated VGAM HOST TARGET PROTEIN. VGAM host target protein is therefore outlined by a broken line.

It is appreciated that VGAM245 host target gene, herein designated VGAM HOST TARGET GENE, in fact represents a plurality of VGAM245 host target genes. The mRNA of each one of this plurality of VGAM245 host target genes comprises one or more host target binding sites, each having a nucleotide sequence which is at least partly complementary to VGAM245 RNA, herein designated VGAM RNA, and which when bound by VGAM245 RNA, herein designated VGAM RNA, causes inhibition of translation of respective one or more VGAM245 host target proteins.

It is further appreciated by one skilled in the art that the mode of translational inhibition illustrated by FIG. 1 with specific reference to translational inhibition exerted by VGAM245 gene, herein designated VGAM GENE, on one or more VGAM245 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM245 is inhibition of expression of host target genes, as part of a novel viral mechanism of attacking a host. Accordingly, utilities of VGAM245 include diagnosis, prevention and treatment of viral infection by Vaccinia virus. Specific functions, and accordingly utilities, of VGAM245 correlate with, and may be deduced from, the identity of the host target genes which VGAM245 binds and inhibits, and the function of these host target genes, as elaborated hereinbelow.

Nucleotide sequences of the VGAM245 precursor RNA, herein designated VGAM PRECURSOR RNA, and of the diced VGAM245 RNA, herein designated VGAM RNA, and a schematic representation of the secondary folding of VGAM245 folded precursor RNA, herein designated VGAM FOLDED PRECURSOR RNA, of VGAM245 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM245 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 246 (VGAM246) viral gene, which modulates expression of respective host target genes thereof, the function and utility of which host target genes is known in the art.

VGAM246 is a novel bioinformatically detected regulatory, non protein coding, viral micro RNA (miRNA) gene. The method by which VGAM246 was detected is described hereinabove with reference to FIGS. 2-8.

VGAM246 gene, herein designated VGAM GENE, is a viral gene contained in the genome of Vaccinia virus. VGAM246 host target gene, herein designated VGAM HOST TARGET GENE, is a human gene contained in the human genome.

VGAM246 gene, herein designated VGAM GENE, encodes a VGAM246 precursor RNA, herein designated VGAM PRECURSOR RNA. Similar to other miRNA genes, and unlike most ordinary genes, VGAM246 precursor RNA, herein designated VGAM PRECURSOR RNA, does not encode a protein. A nucleotide sequence identical or highly similar to the nucleotide sequence of VGAM246 precursor RNA is designated SEQ ID:232, and is provided hereinbelow with reference to the sequence listing part. Nucleotide sequence SEQ ID:232 is located at position 136295 relative to the genome of Vaccinia virus.

VGAM246 precursor RNA, herein designated VGAM PRECURSOR RNA, folds onto itself, forming VGAM246 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM246 folded precursor RNA, herein designated VGAM FOLDED PRECURSOR RNA, into VGAM246 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 78%) nucleotide sequence of VGAM246 RNA is designated SEQ ID:581, and is provided hereinbelow with reference to the sequence listing part.

VGAM246 host target gene, herein designated VGAM HOST TARGET GENE, encodes a corresponding messenger RNA, VGAM246 host target RNA, herein designated VGAM HOST TARGET RNA. VGAM246 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM246 RNA, herein designated VGAM RNA, binds complementarily to one or more host target binding sites located in untranslated regions of VGAM246 host target RNA, herein designated VGAM HOST TARGET RNA. This complementary binding is due to the fact that the nucleotide sequence of VGAM246 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM246 RNA, herein designated VGAM RNA, may have a different number of host target binding sites in untranslated regions of a VGAM246 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM246 RNA, herein designated VGAM RNA, to host target binding sites on VGAM246 host target RNA, herein designated VGAM HOST TARGET RNA, such as BINDING SITE I, BINDING SITE II and BINDING SITE III, inhibits translation of VGAM246 host target RNA, herein designated VGAM HOST TARGET RNA, into VGAM246 host target protein, herein designated VGAM HOST TARGET PROTEIN. VGAM host target protein is therefore outlined by a broken line.

It is appreciated that VGAM246 host target gene, herein designated VGAM HOST TARGET GENE, in fact represents a plurality of VGAM246 host target genes. The mRNA of each one of this plurality of VGAM246 host target genes comprises one or more host target binding sites, each having a nucleotide sequence which is at least partly complementary to VGAM246 RNA, herein designated VGAM RNA, and which when bound by VGAM246 RNA, herein designated VGAM RNA, causes inhibition of translation of respective one or more VGAM246 host target proteins.

It is further appreciated by one skilled in the art that the mode of translational inhibition illustrated by FIG. 1 with specific reference to translational inhibition exerted by VGAM246 gene, herein designated VGAM GENE, on one or more VGAM246 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM246 is inhibition of expression of host target genes, as part of a novel viral mechanism of attacking a host. Accordingly, utilities of VGAM246 include diagnosis, prevention and treatment of viral infection by Vaccinia virus. Specific functions, and accordingly utilities, of VGAM246 correlate with, and may be deduced from, the identity of the host target genes which VGAM246 binds and inhibits, and the function of these host target genes, as elaborated hereinbelow.

Nucleotide sequences of the VGAM246 precursor RNA, herein designated VGAM PRECURSOR RNA, and of the diced VGAM246 RNA, herein designated VGAM RNA, and a schematic representation of the secondary folding of VGAM246 folded precursor RNA, herein designated VGAM FOLDED PRECURSOR RNA, of VGAM246 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM246 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 247 (VGAM247) viral gene, which modulates expression of respective host target genes thereof, the function and utility of which host target genes is known in the art.

VGAM247 is a novel bioinformatically detected regulatory, non protein coding, viral micro RNA (miRNA) gene. The method by which VGAM247 was detected is described hereinabove with reference to FIGS. 2-8.

VGAM247 gene, herein designated VGAM GENE, is a viral gene contained in the genome of Vaccinia virus. VGAM247 host target gene, herein designated VGAM HOST TARGET GENE, is a human gene contained in the human genome.

VGAM247 gene, herein designated VGAM GENE, encodes a VGAM247 precursor RNA, herein designated VGAM PRECURSOR RNA. Similar to other miRNA genes, and unlike most ordinary genes, VGAM247 precursor RNA, herein designated VGAM PRECURSOR RNA, does not encode a protein. A nucleotide sequence identical or highly similar to the nucleotide sequence of VGAM247 precursor RNA is designated SEQ ID:233, and is provided hereinbelow with reference to the sequence listing part. Nucleotide sequence SEQ ID:233 is located at position 138880 relative to the genome of Vaccinia virus.

VGAM247 precursor RNA, herein designated VGAM PRECURSOR RNA, folds onto itself, forming VGAM247 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM247 folded precursor RNA, herein designated VGAM FOLDED PRECURSOR RNA, into VGAM247 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 77%) nucleotide sequence of VGAM247 RNA is designated SEQ ID:582, and is provided hereinbelow with reference to the sequence listing part.

VGAM247 host target gene, herein designated VGAM HOST TARGET GENE, encodes a corresponding messenger RNA, VGAM247 host target RNA, herein designated VGAM HOST TARGET RNA. VGAM247 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM247 RNA, herein designated VGAM RNA, binds complementarily to one or more host target binding sites located in untranslated regions of VGAM247 host target RNA, herein designated VGAM HOST TARGET RNA. This complementary binding is due to the fact that the nucleotide sequence of VGAM247 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM247 RNA, herein designated VGAM RNA, may have a different number of host target binding sites in untranslated regions of a VGAM247 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM247 RNA, herein designated VGAM RNA, to host target binding sites on VGAM247 host target RNA, herein designated VGAM HOST TARGET RNA, such as BINDING SITE I, BINDING SITE II and BINDING SITE III, inhibits translation of VGAM247 host target RNA, herein designated VGAM HOST TARGET RNA, into VGAM247 host target protein, herein designated VGAM HOST TARGET PROTEIN. VGAM host target protein is therefore outlined by a broken line.

It is appreciated that VGAM247 host target gene, herein designated VGAM HOST TARGET GENE, in fact represents a plurality of VGAM247 host target genes. The mRNA of each one of this plurality of VGAM247 host target genes comprises one or more host target binding sites, each having a nucleotide sequence which is at least partly complementary to VGAM247 RNA, herein designated VGAM RNA, and which when bound by VGAM247 RNA, herein designated VGAM RNA, causes inhibition of translation of respective one or more VGAM247 host target proteins.

It is further appreciated by one skilled in the art that the mode of translational inhibition illustrated by FIG. 1 with specific reference to translational inhibition exerted by VGAM247 gene, herein designated VGAM GENE, on one or more VGAM247 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM247 is inhibition of expression of host target genes, as part of a novel viral mechanism of attacking a host. Accordingly, utilities of VGAM247 include diagnosis, prevention and treatment of viral infection by Vaccinia virus. Specific functions, and accordingly utilities, of VGAM247 correlate with, and may be deduced from, the identity of the host target genes which VGAM247 binds and inhibits, and the function of these host target genes, as elaborated hereinbelow.

Nucleotide sequences of the VGAM247 precursor RNA, herein designated VGAM PRECURSOR RNA, and of the diced VGAM247 RNA, herein designated VGAM RNA, and a schematic representation of the secondary folding of VGAM247 folded precursor RNA, herein designated VGAM FOLDED PRECURSOR RNA, of VGAM247 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM247 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 248 (VGAM248) viral gene, which modulates expression of respective host target genes thereof, the function and utility of which host target genes is known in the art.

VGAM248 is a novel bioinformatically detected regulatory, non protein coding, viral micro RNA (miRNA) gene. The method by which VGAM248 was detected is described hereinabove with reference to FIGS. 2-8.

VGAM248 gene, herein designated VGAM GENE, is a viral gene contained in the genome of Vaccinia virus. VGAM248 host target gene, herein designated VGAM HOST TARGET GENE, is a human gene contained in the human genome.

VGAM248 gene, herein designated VGAM GENE, encodes a VGAM248 precursor RNA, herein designated VGAM PRECURSOR RNA. Similar to other miRNA genes, and unlike most ordinary genes, VGAM248 precursor RNA, herein designated VGAM PRECURSOR RNA, does not encode a protein. A nucleotide sequence identical or highly similar to the nucleotide sequence of VGAM248 precursor RNA is designated SEQ ID:234, and is provided hereinbelow with reference to the sequence listing part. Nucleotide sequence SEQ ID:234 is located at position 138729 relative to the genome of Vaccinia virus.

VGAM248 precursor RNA, herein designated VGAM PRECURSOR RNA, folds onto itself, forming VGAM248 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM248 folded precursor RNA, herein designated VGAM FOLDED PRECURSOR RNA, into VGAM248 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 86%) nucleotide sequence of VGAM248 RNA is designated SEQ ID:583, and is provided hereinbelow with reference to the sequence listing part.

VGAM248 host target gene, herein designated VGAM HOST TARGET GENE, encodes a corresponding messenger RNA, VGAM248 host target RNA, herein designated VGAM HOST TARGET RNA. VGAM248 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM248 RNA, herein designated VGAM RNA, binds complementarily to one or more host target binding sites located in untranslated regions of VGAM248 host target RNA, herein designated VGAM HOST TARGET RNA. This complementary binding is due to the fact that the nucleotide sequence of VGAM248 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM248 RNA, herein designated VGAM RNA, may have a different number of host target binding sites in untranslated regions of a VGAM248 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM248 RNA, herein designated VGAM RNA, to host target binding sites on VGAM248 host target RNA, herein designated VGAM HOST TARGET RNA, such as BINDING SITE I, BINDING SITE II and BINDING SITE III, inhibits translation of VGAM248 host target RNA, herein designated VGAM HOST TARGET RNA, into VGAM248 host target protein, herein designated VGAM HOST TARGET PROTEIN. VGAM host target protein is therefore outlined by a broken line.

It is appreciated that VGAM248 host target gene, herein designated VGAM HOST TARGET GENE, in fact represents a plurality of VGAM248 host target genes. The mRNA of each one of this plurality of VGAM248 host target genes comprises one or more host target binding sites, each having a nucleotide sequence which is at least partly complementary to VGAM248 RNA, herein designated VGAM RNA, and which when bound by VGAM248 RNA, herein designated VGAM RNA, causes inhibition of translation of respective one or more VGAM248 host target proteins.

It is further appreciated by one skilled in the art that the mode of translational inhibition illustrated by FIG. 1 with specific reference to translational inhibition exerted by VGAM248 gene, herein designated VGAM GENE, on one or more VGAM248 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM248 is inhibition of expression of host target genes, as part of a novel viral mechanism of attacking a host. Accordingly, utilities of VGAM248 include diagnosis, prevention and treatment of viral infection by Vaccinia virus. Specific functions, and accordingly utilities, of VGAM248 correlate with, and may be deduced from, the identity of the host target genes which VGAM248 binds and inhibits, and the function of these host target genes, as elaborated hereinbelow.

Nucleotide sequences of the VGAM248 precursor RNA, herein designated VGAM PRECURSOR RNA, and of the diced VGAM248 RNA, herein designated VGAM RNA, and a schematic representation of the secondary folding of VGAM248 folded precursor RNA, herein designated VGAM FOLDED PRECURSOR RNA, of VGAM248 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM248 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 249 (VGAM249) viral gene, which modulates expression of respective host target genes thereof, the function and utility of which host target genes is known in the art.

VGAM249 is a novel bioinformatically detected regulatory, non protein coding, viral micro RNA (miRNA) gene. The method by which VGAM249 was detected is described hereinabove with reference to FIGS. 2-8.

VGAM249 gene, herein designated VGAM GENE, is a viral gene contained in the genome of Vaccinia virus. VGAM249 host target gene, herein designated VGAM HOST TARGET GENE, is a human gene contained in the human genome.

VGAM249 gene, herein designated VGAM GENE, encodes a VGAM249 precursor RNA, herein designated VGAM PRECURSOR RNA. Similar to other miRNA genes, and unlike most ordinary genes, VGAM249 precursor RNA, herein designated VGAM PRECURSOR RNA, does not encode a protein. A nucleotide sequence identical or highly similar to the nucleotide sequence of VGAM249 precursor RNA is designated SEQ ID:235, and is provided hereinbelow with reference to the sequence listing part. Nucleotide sequence SEQ ID:235 is located at position 139033 relative to the genome of Vaccinia virus.

VGAM249 precursor RNA, herein designated VGAM PRECURSOR RNA, folds onto itself, forming VGAM249 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM249 folded precursor RNA, herein designated VGAM FOLDED PRECURSOR RNA, into VGAM249 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 74%) nucleotide sequence of VGAM249 RNA is designated SEQ ID:584, and is provided hereinbelow with reference to the sequence listing part.

VGAM249 host target gene, herein designated VGAM HOST TARGET GENE, encodes a corresponding messenger RNA, VGAM249 host target RNA, herein designated VGAM HOST TARGET RNA. VGAM249 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM249 RNA, herein designated VGAM RNA, binds complementarily to one or more host target binding sites located in untranslated regions of VGAM249 host target RNA, herein designated VGAM HOST TARGET RNA. This complementary binding is due to the fact that the nucleotide sequence of VGAM249 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM249 RNA, herein designated VGAM RNA, may have a different number of host target binding sites in untranslated regions of a VGAM249 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM249 RNA, herein designated VGAM RNA, to host target binding sites on VGAM249 host target RNA, herein designated VGAM HOST TARGET RNA, such as BINDING SITE I, BINDING SITE II and BINDING SITE III, inhibits translation of VGAM249 host target RNA, herein designated VGAM HOST TARGET RNA, into VGAM249 host target protein, herein designated VGAM HOST TARGET PROTEIN. VGAM host target protein is therefore outlined by a broken line.

It is appreciated that VGAM249 host target gene, herein designated VGAM HOST TARGET GENE, in fact represents a plurality of VGAM249 host target genes. The mRNA of each one of this plurality of VGAM249 host target genes comprises one or more host target binding sites, each having a nucleotide sequence which is at least partly complementary to VGAM249 RNA, herein designated VGAM RNA, and which when bound by VGAM249 RNA, herein designated VGAM RNA, causes inhibition of translation of respective one or more VGAM249 host target proteins.

It is further appreciated by one skilled in the art that the mode of translational inhibition illustrated by FIG. 1 with specific reference to translational inhibition exerted by VGAM249 gene, herein designated VGAM GENE, on one or more VGAM249 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM249 is inhibition of expression of host target genes, as part of a novel viral mechanism of attacking a host. Accordingly, utilities of VGAM249 include diagnosis, prevention and treatment of viral infection by Vaccinia virus. Specific functions, and accordingly utilities, of VGAM249 correlate with, and may be deduced from, the identity of the host target genes which VGAM249 binds and inhibits, and the function of these host target genes, as elaborated hereinbelow.

Nucleotide sequences of the VGAM249 precursor RNA, herein designated VGAM PRECURSOR RNA, and of the diced VGAM249 RNA, herein designated VGAM RNA, and a schematic representation of the secondary folding of VGAM249 folded precursor RNA, herein designated VGAM FOLDED PRECURSOR RNA, of VGAM249 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM249 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 250 (VGAM250) viral gene, which modulates expression of respective host target genes thereof, the function and utility of which host target genes is known in the art.

VGAM250 is a novel bioinformatically detected regulatory, non protein coding, viral micro RNA (miRNA) gene. The method by which VGAM250 was detected is described hereinabove with reference to FIGS. 2-8.

VGAM250 gene, herein designated VGAM GENE, is a viral gene contained in the genome of Vaccinia virus. VGAM250 host target gene, herein designated VGAM HOST TARGET GENE, is a human gene contained in the human genome.

VGAM250 gene, herein designated VGAM GENE, encodes a VGAM250 precursor RNA, herein designated VGAM PRECURSOR RNA. Similar to other miRNA genes, and unlike most ordinary genes, VGAM250 precursor RNA, herein designated VGAM PRECURSOR RNA, does not encode a protein. A nucleotide sequence identical or highly similar to the nucleotide sequence of VGAM250 precursor RNA is designated SEQ ID:236, and is provided hereinbelow with reference to the sequence listing part. Nucleotide sequence SEQ ID:236 is located at position 139228 relative to the genome of Vaccinia virus.

VGAM250 precursor RNA, herein designated VGAM PRECURSOR RNA, folds onto itself, forming VGAM250 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM250 folded precursor RNA, herein designated VGAM FOLDED PRECURSOR RNA, into VGAM250 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 71%) nucleotide sequence of VGAM250 RNA is designated SEQ ID:585, and is provided hereinbelow with reference to the sequence listing part.

VGAM250 host target gene, herein designated VGAM HOST TARGET GENE, encodes a corresponding messenger RNA, VGAM250 host target RNA, herein designated VGAM HOST TARGET RNA. VGAM250 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM250 RNA, herein designated VGAM RNA, binds complementarily to one or more host target binding sites located in untranslated regions of VGAM250 host target RNA, herein designated VGAM HOST TARGET RNA. This complementary binding is due to the fact that the nucleotide sequence of VGAM250 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM250 RNA, herein designated VGAM RNA, may have a different number of host target binding sites in untranslated regions of a VGAM250 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM250 RNA, herein designated VGAM RNA, to host target binding sites on VGAM250 host target RNA, herein designated VGAM HOST TARGET RNA, such as BINDING SITE I, BINDING SITE II and BINDING SITE III, inhibits translation of VGAM250 host target RNA, herein designated VGAM HOST TARGET RNA, into VGAM250 host target protein, herein designated VGAM HOST TARGET PROTEIN. VGAM host target protein is therefore outlined by a broken line.

It is appreciated that VGAM250 host target gene, herein designated VGAM HOST TARGET GENE, in fact represents a plurality of VGAM250 host target genes. The mRNA of each one of this plurality of VGAM250 host target genes comprises one or more host target binding sites, each having a nucleotide sequence which is at least partly complementary to VGAM250 RNA, herein designated VGAM RNA, and which when bound by VGAM250 RNA, herein designated VGAM RNA, causes inhibition of translation of respective one or more VGAM250 host target proteins.

It is further appreciated by one skilled in the art that the mode of translational inhibition illustrated by FIG. 1 with specific reference to translational inhibition exerted by VGAM250 gene, herein designated VGAM GENE, on one or more VGAM250 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM250 is inhibition of expression of host target genes, as part of a novel viral mechanism of attacking a host. Accordingly, utilities of VGAM250 include diagnosis, prevention and treatment of viral infection by Vaccinia virus. Specific functions, and accordingly utilities, of VGAM250 correlate with, and may be deduced from, the identity of the host target genes which VGAM250 binds and inhibits, and the function of these host target genes, as elaborated hereinbelow.

Nucleotide sequences of the VGAM250 precursor RNA, herein designated VGAM PRECURSOR RNA, and of the diced VGAM250 RNA, herein designated VGAM RNA, and a schematic representation of the secondary folding of VGAM250 folded precursor RNA, herein designated VGAM FOLDED PRECURSOR RNA, of VGAM250 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM250 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 251 (VGAM251) viral gene, which modulates expression of respective host target genes thereof, the function and utility of which host target genes is known in the art.

VGAM251 is a novel bioinformatically detected regulatory, non protein coding, viral micro RNA (miRNA) gene. The method by which VGAM251 was detected is described hereinabove with reference to FIGS. 2-8.

VGAM251 gene, herein designated VGAM GENE, is a viral gene contained in the genome of Vaccinia virus. VGAM251 host target gene, herein designated VGAM HOST TARGET GENE, is a human gene contained in the human genome.

VGAM251 gene, herein designated VGAM GENE, encodes a VGAM251 precursor RNA, herein designated VGAM PRECURSOR RNA. Similar to other miRNA genes, and unlike most ordinary genes, VGAM251 precursor RNA, herein designated VGAM PRECURSOR RNA, does not encode a protein. A nucleotide sequence identical or highly similar to the nucleotide sequence of VGAM251 precursor RNA is designated SEQ ID:237, and is provided hereinbelow with reference to the sequence listing part. Nucleotide sequence SEQ ID:237 is located at position 137709 relative to the genome of Vaccinia virus.

VGAM251 precursor RNA, herein designated VGAM PRECURSOR RNA, folds onto itself, forming VGAM251 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM251 folded precursor RNA, herein designated VGAM FOLDED PRECURSOR RNA, into VGAM251 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM251 RNA is designated SEQ ID:586, and is provided hereinbelow with reference to the sequence listing part.

VGAM251 host target gene, herein designated VGAM HOST TARGET GENE, encodes a corresponding messenger RNA, VGAM251 host target RNA, herein designated VGAM HOST TARGET RNA. VGAM251 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM251 RNA, herein designated VGAM RNA, binds complementarily to one or more host target binding sites located in untranslated regions of VGAM251 host target RNA, herein designated VGAM HOST TARGET RNA. This complementary binding is due to the fact that the nucleotide sequence of VGAM251 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM251 RNA, herein designated VGAM RNA, may have a different number of host target binding sites in untranslated regions of a VGAM251 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM251 RNA, herein designated VGAM RNA, to host target binding sites on VGAM251 host target RNA, herein designated VGAM HOST TARGET RNA, such as BINDING SITE I, BINDING SITE II and BINDING SITE III, inhibits translation of VGAM251 host target RNA, herein designated VGAM HOST TARGET RNA, into VGAM251 host target protein, herein designated VGAM HOST TARGET PROTEIN. VGAM host target protein is therefore outlined by a broken line.

It is appreciated that VGAM251 host target gene, herein designated VGAM HOST TARGET GENE, in fact represents a plurality of VGAM251 host target genes. The mRNA of each one of this plurality of VGAM251 host target genes comprises one or more host target binding sites, each having a nucleotide sequence which is at least partly complementary to VGAM251 RNA, herein designated VGAM RNA, and which when bound by VGAM251 RNA, herein designated VGAM RNA, causes inhibition of translation of respective one or more VGAM251 host target proteins.

It is further appreciated by one skilled in the art that the mode of translational inhibition illustrated by FIG. 1 with specific reference to translational inhibition exerted by VGAM251 gene, herein designated VGAM GENE, on one or more VGAM251 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM251 is inhibition of expression of host target genes, as part of a novel viral mechanism of attacking a host. Accordingly, utilities of VGAM251 include diagnosis, prevention and treatment of viral infection by Vaccinia virus. Specific functions, and accordingly utilities, of VGAM251 correlate with, and may be deduced from, the identity of the host target genes which VGAM251 binds and inhibits, and the function of these host target genes, as elaborated hereinbelow.

Nucleotide sequences of the VGAM251 precursor RNA, herein designated VGAM PRECURSOR RNA, and of the diced VGAM251 RNA, herein designated VGAM RNA, and a schematic representation of the secondary folding of VGAM251 folded precursor RNA, herein designated VGAM FOLDED PRECURSOR RNA, of VGAM251 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM251 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 252 (VGAM252) viral gene, which modulates expression of respective host target genes thereof, the function and utility of which host target genes is known in the art.

VGAM252 is a novel bioinformatically detected regulatory, non protein coding, viral micro RNA (miRNA) gene. The method by which VGAM252 was detected is described hereinabove with reference to FIGS. 2-8.

VGAM252 gene, herein designated VGAM GENE, is a viral gene contained in the genome of Vaccinia virus. VGAM252 host target gene, herein designated VGAM HOST TARGET GENE, is a human gene contained in the human genome.

VGAM252 gene, herein designated VGAM GENE, encodes a VGAM252 precursor RNA, herein designated VGAM PRECURSOR RNA. Similar to other miRNA genes, and unlike most ordinary genes, VGAM252 precursor RNA, herein designated VGAM PRECURSOR RNA, does not encode a protein. A nucleotide sequence identical or highly similar to the nucleotide sequence of VGAM252 precursor RNA is designated SEQ ID:238, and is provided hereinbelow with reference to the sequence listing part. Nucleotide sequence SEQ ID:238 is located at position 140854 relative to the genome of Vaccinia virus.

VGAM252 precursor RNA, herein designated VGAM PRECURSOR RNA, folds onto itself, forming VGAM252 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM252 folded precursor RNA, herein designated VGAM FOLDED PRECURSOR RNA, into VGAM252 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM252 RNA is designated SEQ ID:587, and is provided hereinbelow with reference to the sequence listing part.

VGAM252 host target gene, herein designated VGAM HOST TARGET GENE, encodes a corresponding messenger RNA, VGAM252 host target RNA, herein designated VGAM HOST TARGET RNA. VGAM252 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM252 RNA, herein designated VGAM RNA, binds complementarily to one or more host target binding sites located in untranslated regions of VGAM252 host target RNA, herein designated VGAM HOST TARGET RNA. This complementary binding is due to the fact that the nucleotide sequence of VGAM252 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM252 RNA, herein designated VGAM RNA, may have a different number of host target binding sites in untranslated regions of a VGAM252 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM252 RNA, herein designated VGAM RNA, to host target binding sites on VGAM252 host target RNA, herein designated VGAM HOST TARGET RNA, such as BINDING SITE I, BINDING SITE II and BINDING SITE III, inhibits translation of VGAM252 host target RNA, herein designated VGAM HOST TARGET RNA, into VGAM252 host target protein, herein designated VGAM HOST TARGET PROTEIN. VGAM host target protein is therefore outlined by a broken line.

It is appreciated that VGAM252 host target gene, herein designated VGAM HOST TARGET GENE, in fact represents a plurality of VGAM252 host target genes. The mRNA of each one of this plurality of VGAM252 host target genes comprises one or more host target binding sites, each having a nucleotide sequence which is at least partly complementary to VGAM252 RNA, herein designated VGAM RNA, and which when bound by VGAM252 RNA, herein designated VGAM RNA, causes inhibition of translation of respective one or more VGAM252 host target proteins.

It is further appreciated by one skilled in the art that the mode of translational inhibition illustrated by FIG. 1 with specific reference to translational inhibition exerted by VGAM252 gene, herein designated VGAM GENE, on one or more VGAM252 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM252 is inhibition of expression of host target genes, as part of a novel viral mechanism of attacking a host. Accordingly, utilities of VGAM252 include diagnosis, prevention and treatment of viral infection by Vaccinia virus. Specific functions, and accordingly utilities, of VGAM252 correlate with, and may be deduced from, the identity of the host target genes which VGAM252 binds and inhibits, and the function of these host target genes, as elaborated hereinbelow.

Nucleotide sequences of the VGAM252 precursor RNA, herein designated VGAM PRECURSOR RNA, and of the diced VGAM252 RNA, herein designated VGAM RNA, and a schematic representation of the secondary folding of VGAM252 folded precursor RNA, herein designated VGAM FOLDED PRECURSOR RNA, of VGAM252 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM252 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 253 (VGAM253) viral gene, which modulates expression of respective host target genes thereof, the function and utility of which host target genes is known in the art.

VGAM253 is a novel bioinformatically detected regulatory, non protein coding, viral micro RNA (miRNA) gene. The method by which VGAM253 was detected is described hereinabove with reference to FIGS. 2-8.

VGAM253 gene, herein designated VGAM GENE, is a viral gene contained in the genome of Vaccinia virus. VGAM253 host target gene, herein designated VGAM HOST TARGET GENE, is a human gene contained in the human genome.

VGAM253 gene, herein designated VGAM GENE, encodes a VGAM253 precursor RNA, herein designated VGAM PRECURSOR RNA. Similar to other miRNA genes, and unlike most ordinary genes, VGAM253 precursor RNA, herein designated VGAM PRECURSOR RNA, does not encode a protein. A nucleotide sequence identical or highly similar to the nucleotide sequence of VGAM253 precursor RNA is designated SEQ ID:239, and is provided hereinbelow with reference to the sequence listing part. Nucleotide sequence SEQ ID:239 is located at position 140990 relative to the genome of Vaccinia virus.

VGAM253 precursor RNA, herein designated VGAM PRECURSOR RNA, folds onto itself, forming VGAM253 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM253 folded precursor RNA, herein designated VGAM FOLDED PRECURSOR RNA, into VGAM253 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 71%) nucleotide sequence of VGAM253 RNA is designated SEQ ID:588, and is provided hereinbelow with reference to the sequence listing part.

VGAM253 host target gene, herein designated VGAM HOST TARGET GENE, encodes a corresponding messenger RNA, VGAM253 host target RNA, herein designated VGAM HOST TARGET RNA. VGAM253 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM253 RNA, herein designated VGAM RNA, binds complementarily to one or more host target binding sites located in untranslated regions of VGAM253 host target RNA, herein designated VGAM HOST TARGET RNA. This complementary binding is due to the fact that the nucleotide sequence of VGAM253 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting. VGAM253 RNA, herein designated VGAM RNA, may have a different number of host target binding sites in untranslated regions of a VGAM253 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM253 RNA, herein designated VGAM RNA, to host target binding sites on VGAM253 host target RNA, herein designated VGAM HOST TARGET RNA, such as BINDING SITE I, BINDING SITE II and BINDING SITE III, inhibits translation of VGAM253 host target RNA, herein designated VGAM HOST TARGET RNA, into VGAM253 host target protein, herein designated VGAM HOST TARGET PROTEIN. VGAM host target protein is therefore outlined by a broken line.

It is appreciated that VGAM253 host target gene, herein designated VGAM HOST TARGET GENE, in fact represents a plurality of VGAM253 host target genes. The mRNA of each one of this plurality of VGAM253 host target genes comprises one or more host target binding sites, each having a nucleotide sequence which is at least partly complementary to VGAM253 RNA, herein designated VGAM RNA, and which when bound by VGAM253 RNA, herein designated VGAM RNA, causes inhibition of translation of respective one or more VGAM253 host target proteins.

It is further appreciated by one skilled in the art that the mode of translational inhibition illustrated by FIG. 1 with specific reference to translational inhibition exerted by VGAM253 gene, herein designated VGAM GENE, on one or more VGAM253 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM253 is inhibition of expression of host target genes, as part of a novel viral mechanism of attacking a host. Accordingly, utilities of VGAM253 include diagnosis, prevention and treatment of viral infection by Vaccinia virus. Specific functions, and accordingly utilities, of VGAM253 correlate with, and may be deduced from, the identity of the host target genes which VGAM253 binds and inhibits, and the function of these host target genes, as elaborated hereinbelow.

Nucleotide sequences of the VGAM253 precursor RNA, herein designated VGAM PRECURSOR RNA, and of the diced VGAM253 RNA, herein designated VGAM RNA, and a schematic representation of the secondary folding of VGAM253 folded precursor RNA, herein designated VGAM FOLDED PRECURSOR RNA, of VGAM253 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM253 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 254 (VGAM254) viral gene, which modulates expression of respective host target genes thereof, the function and utility of which host target genes is known in the art.

VGAM254 is a novel bioinformatically detected regulatory, non protein coding, viral micro RNA (miRNA) gene. The method by which VGAM254 was detected is described hereinabove with reference to FIGS. 2-8.

VGAM254 gene, herein designated VGAM GENE, is a viral gene contained in the genome of Vaccinia virus. VGAM254 host target gene, herein designated VGAM HOST TARGET GENE, is a human gene contained in the human genome.

VGAM254 gene, herein designated VGAM GENE, encodes a VGAM254 precursor RNA, herein designated VGAM PRECURSOR RNA. Similar to other miRNA genes, and unlike most ordinary genes, VGAM254 precursor RNA, herein designated VGAM PRECURSOR RNA, does not encode a protein. A nucleotide sequence identical or highly similar to the nucleotide sequence of VGAM254 precursor RNA is designated SEQ ID:240, and is provided hereinbelow with reference to the sequence listing part. Nucleotide sequence SEQ ID:240 is located at position 141210 relative to the genome of Vaccinia virus.

VGAM254 precursor RNA, herein designated VGAM PRECURSOR RNA, folds onto itself, forming VGAM254 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM254 folded precursor RNA, herein designated VGAM FOLDED PRECURSOR RNA, into VGAM254 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 70%) nucleotide sequence of VGAM254 RNA is designated SEQ ID:589, and is provided hereinbelow with reference to the sequence listing part.

VGAM254 host target gene, herein designated VGAM HOST TARGET GENE, encodes a corresponding messenger RNA, VGAM254 host target RNA, herein designated VGAM HOST TARGET RNA. VGAM254 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM254 RNA, herein designated VGAM RNA, binds complementarily to one or more host target binding sites located in untranslated regions of VGAM254 host target RNA, herein designated VGAM HOST TARGET RNA. This complementary binding is due to the fact that the nucleotide sequence of VGAM254 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM254 RNA, herein designated VGAM RNA, may have a different number of host target binding sites in untranslated regions of a VGAM254 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM254 RNA, herein designated VGAM RNA, to host target binding sites on VGAM254 host target RNA, herein designated VGAM HOST TARGET RNA, such as BINDING SITE I, BINDING SITE II and BINDING SITE III, inhibits translation of VGAM254 host target RNA, herein designated VGAM HOST TARGET RNA, into VGAM254 host target protein, herein designated VGAM HOST TARGET PROTEIN. VGAM host target protein is therefore outlined by a broken line.

It is appreciated that VGAM254 host target gene, herein designated VGAM HOST TARGET GENE, in fact represents a plurality of VGAM254 host target genes. The mRNA of each one of this plurality of VGAM254 host target genes comprises one or more host target binding sites, each having a nucleotide sequence which is at least partly complementary to VGAM254 RNA, herein designated VGAM RNA, and which when bound by VGAM254 RNA, herein designated VGAM RNA, causes inhibition of translation of respective one or more VGAM254 host target proteins.

It is further appreciated by one skilled in the art that the mode of translational inhibition illustrated by FIG. 1 with specific reference to translational inhibition exerted by VGAM254 gene, herein designated VGAM GENE, on one or more VGAM254 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM254 is inhibition of expression of host target genes, as part of a novel viral mechanism of attacking a host. Accordingly, utilities of VGAM254 include diagnosis, prevention and treatment of viral infection by Vaccinia virus. Specific functions, and accordingly utilities, of VGAM254 correlate with, and may be deduced from, the identity of the host target genes which VGAM254 binds and inhibits, and the function of these host target genes, as elaborated hereinbelow.

Nucleotide sequences of the VGAM254 precursor RNA, herein designated VGAM PRECURSOR RNA, and of the diced VGAM254 RNA, herein designated VGAM RNA, and a schematic representation of the secondary folding of VGAM254 folded precursor RNA, herein designated VGAM FOLDED PRECURSOR RNA, of VGAM254 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM254 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 255 (VGAM255) viral gene, which modulates expression of respective host target genes thereof, the function and utility of which host target genes is known in the art.

VGAM255 is a novel bioinformatically detected regulatory, non protein coding, viral micro RNA (miRNA) gene. The method by which VGAM255 was detected is described hereinabove with reference to FIGS. 2-8.

VGAM255 gene, herein designated VGAM GENE, is a viral gene contained in the genome of Vaccinia virus. VGAM255 host target gene, herein designated VGAM HOST TARGET GENE, is a human gene contained in the human genome.

VGAM255 gene, herein designated VGAM GENE, encodes a VGAM255 precursor RNA, herein designated VGAM PRECURSOR RNA. Similar to other miRNA genes, and unlike most ordinary genes, VGAM255 precursor RNA, herein designated VGAM PRECURSOR RNA, does not encode a protein. A nucleotide sequence identical or highly similar to the nucleotide sequence of VGAM255 precursor RNA is designated SEQ ID:241, and is provided hereinbelow with reference to the sequence listing part. Nucleotide sequence SEQ ID:241 is located at position 141044 relative to the genome of Vaccinia virus.

VGAM255 precursor RNA, herein designated VGAM PRECURSOR RNA, folds onto itself, forming VGAM255 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM255 folded precursor RNA, herein designated VGAM FOLDED PRECURSOR RNA, into VGAM255 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM255 RNA is designated SEQ ID:590, and is provided hereinbelow with reference to the sequence listing part.

VGAM255 host target gene, herein designated VGAM HOST TARGET GENE, encodes a corresponding messenger RNA, VGAM255 host target RNA, herein designated VGAM HOST TARGET RNA. VGAM255 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM255 RNA, herein designated VGAM RNA, binds complementarily to one or more host target binding sites located in untranslated regions of VGAM255 host target RNA, herein designated VGAM HOST TARGET RNA. This complementary binding is due to the fact that the nucleotide sequence of VGAM255 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM255 RNA, herein designated VGAM RNA, may have a different number of host target binding sites in untranslated regions of a VGAM255 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM255 RNA, herein designated VGAM RNA, to host target binding sites on VGAM255 host target RNA, herein designated VGAM HOST TARGET RNA, such as BINDING SITE I, BINDING SITE II and BINDING SITE III, inhibits translation of VGAM255 host target RNA, herein designated VGAM HOST TARGET RNA, into VGAM255 host target protein, herein designated VGAM HOST TARGET PROTEIN. VGAM host target protein is therefore outlined by a broken line.

It is appreciated that VGAM255 host target gene, herein designated VGAM HOST TARGET GENE, in fact represents a plurality of VGAM255 host target genes. The mRNA of each one of this plurality of VGAM255 host target genes comprises one or more host target binding sites, each having a nucleotide sequence which is at least partly complementary to VGAM255 RNA, herein designated VGAM RNA, and which when bound by VGAM255 RNA, herein designated VGAM RNA, causes inhibition of translation of respective one or more VGAM255 host target proteins.

It is further appreciated by one skilled in the art that the mode of translational inhibition illustrated by FIG. 1 with specific reference to translational inhibition exerted by VGAM255 gene, herein designated VGAM GENE, on one or more VGAM255 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM255 is inhibition of expression of host target genes, as part of a novel viral mechanism of attacking a host. Accordingly, utilities of VGAM255 include diagnosis, prevention and treatment of viral infection by Vaccinia virus. Specific functions, and accordingly utilities, of VGAM255 correlate with, and may be deduced from, the identity of the host target genes which VGAM255 binds and inhibits, and the function of these host target genes, as elaborated hereinbelow.

Nucleotide sequences of the VGAM255 precursor RNA, herein designated VGAM PRECURSOR RNA, and of the diced VGAM255 RNA, herein designated VGAM RNA, and a schematic representation of the secondary folding of VGAM255 folded precursor RNA, herein designated VGAM FOLDED PRECURSOR RNA, of VGAM255 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM255 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 256 (VGAM256) viral gene, which modulates expression of respective host target genes thereof, the function and utility of which host target genes is known in the art.

VGAM256 is a novel bioinformatically detected regulatory, non protein coding, viral micro RNA (miRNA) gene. The method by which VGAM256 was detected is described hereinabove with reference to FIGS. 2-8.

VGAM256 gene, herein designated VGAM GENE, is a viral gene contained in the genome of Vaccinia virus. VGAM256 host target gene, herein designated VGAM HOST TARGET GENE, is a human gene contained in the human genome.

VGAM256 gene, herein designated VGAM GENE, encodes a VGAM256 precursor RNA, herein designated VGAM PRECURSOR RNA. Similar to other miRNA genes, and unlike most ordinary genes, VGAM256 precursor RNA, herein designated VGAM PRECURSOR RNA, does not encode a protein. A nucleotide sequence identical or highly similar to the nucleotide sequence of VGAM256 precursor RNA is designated SEQ ID:242, and is provided hereinbelow with reference to the sequence listing part. Nucleotide sequence SEQ ID:242 is located at position 143051 relative to the genome of Vaccinia virus.

VGAM256 precursor RNA, herein designated VGAM PRECURSOR RNA, folds onto itself, forming VGAM256 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM256 folded precursor RNA, herein designated VGAM FOLDED PRECURSOR RNA, into VGAM256 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 85%) nucleotide sequence of VGAM256 RNA is designated SEQ ID:591, and is provided hereinbelow with reference to the sequence listing part.

VGAM256 host target gene, herein designated VGAM HOST TARGET GENE, encodes a corresponding messenger RNA, VGAM256 host target RNA, herein designated VGAM HOST TARGET RNA. VGAM256 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM256 RNA, herein designated VGAM RNA, binds complementarily to one or more host target binding sites located in untranslated regions of VGAM256 host target RNA, herein designated VGAM HOST TARGET RNA. This complementary binding is due to the fact that the nucleotide sequence of VGAM256 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM256 RNA, herein designated VGAM RNA, may have a different number of host target binding sites in untranslated regions of a VGAM256 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM256 RNA, herein designated VGAM RNA, to host target binding sites on VGAM256 host target RNA, herein designated VGAM HOST TARGET RNA, such as BINDING SITE I, BINDING SITE II and BINDING SITE III, inhibits translation of VGAM256 host target RNA, herein designated VGAM HOST TARGET RNA, into VGAM256 host target protein, herein designated VGAM HOST TARGET PROTEIN. VGAM host target protein is therefore outlined by a broken line.

It is appreciated that VGAM256 host target gene, herein designated VGAM HOST TARGET GENE, in fact represents a plurality of VGAM256 host target genes. The mRNA of each one of this plurality of VGAM256 host target genes comprises one or more host target binding sites, each having a nucleotide sequence which is at least partly complementary to VGAM256 RNA, herein designated VGAM RNA, and which when bound by VGAM256 RNA, herein designated VGAM RNA, causes inhibition of translation of respective one or more VGAM256 host target proteins.

It is further appreciated by one skilled in the art that the mode of translational inhibition illustrated by FIG. 1 with specific reference to translational inhibition exerted by VGAM256 gene, herein designated VGAM GENE, on one or more VGAM256 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM256 is inhibition of expression of host target genes, as part of a novel viral mechanism of attacking a host. Accordingly, utilities of VGAM256 include diagnosis, prevention and treatment of viral infection by Vaccinia virus. Specific functions, and accordingly utilities, of VGAM256 correlate with, and may be deduced from, the identity of the host target genes which VGAM256 binds and inhibits, and the function of these host target genes, as elaborated hereinbelow.

Nucleotide sequences of the VGAM256 precursor RNA, herein designated VGAM PRECURSOR RNA, and of the diced VGAM256 RNA, herein designated VGAM RNA, and a schematic representation of the secondary folding of VGAM256 folded precursor RNA, herein designated VGAM FOLDED PRECURSOR RNA, of VGAM256 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM256 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 257 (VGAM257) viral gene, which modulates expression of respective host target genes thereof, the function and utility of which host target genes is known in the art.

VGAM257 is a novel bioinformatically detected regulatory, non protein coding, viral micro RNA (miRNA) gene. The method by which VGAM257 was detected is described hereinabove with reference to FIGS. 2-8.

VGAM257 gene, herein designated VGAM GENE, is a viral gene contained in the genome of Vaccinia virus.

VGAM257 host target gene, herein designated VGAM HOST TARGET GENE, is a human gene contained in the human genome.

VGAM257 gene, herein designated VGAM GENE, encodes a VGAM257 precursor RNA, herein designated VGAM PRECURSOR RNA. Similar to other miRNA genes, and unlike most ordinary genes, VGAM257 precursor RNA, herein designated VGAM PRECURSOR RNA, does not encode a protein. A nucleotide sequence identical or highly similar to the nucleotide sequence of VGAM257 precursor RNA is designated SEQ ID:243, and is provided hereinbelow with reference to the sequence listing part. Nucleotide sequence SEQ ID:243 is located at position 142696 relative to the genome of Vaccinia virus.

VGAM257 precursor RNA, herein designated VGAM PRECURSOR RNA, folds onto itself, forming VGAM257 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM257 folded precursor RNA, herein designated VGAM FOLDED PRECURSOR RNA, into VGAM257 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM257 RNA is designated SEQ ID:592, and is provided hereinbelow with reference to the sequence listing part.

VGAM257 host target gene, herein designated VGAM HOST TARGET GENE, encodes a corresponding messenger RNA, VGAM257 host target RNA, herein designated VGAM HOST TARGET RNA. VGAM257 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM257 RNA, herein designated VGAM RNA, binds complementarily to one or more host target binding sites located in untranslated regions of VGAM257 host target RNA, herein designated VGAM HOST TARGET RNA. This complementary binding is due to the fact that the nucleotide sequence of VGAM257 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM257 RNA, herein designated VGAM RNA, may have a different number of host target binding sites in untranslated regions of a VGAM257 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM257 RNA, herein designated VGAM RNA, to host target binding sites on VGAM257 host target RNA, herein designated VGAM HOST TARGET RNA, such as BINDING SITE I, BINDING SITE II and BINDING SITE III, inhibits translation of VGAM257 host target RNA, herein designated VGAM HOST TARGET RNA, into VGAM257 host target protein, herein designated VGAM HOST TARGET PROTEIN. VGAM host target protein is therefore outlined by a broken line.

It is appreciated that VGAM257 host target gene, herein designated VGAM HOST TARGET GENE, in fact represents a plurality of VGAM257 host target genes. The mRNA of each one of this plurality of VGAM257 host target genes comprises one or more host target binding sites, each having a nucleotide sequence which is at least partly complementary to VGAM257 RNA, herein designated VGAM RNA, and which when bound by VGAM257 RNA, herein designated VGAM RNA, causes inhibition of translation of respective one or more VGAM257 host target proteins.

It is further appreciated by one skilled in the art that the mode of translational inhibition illustrated by FIG. 1 with specific reference to translational inhibition exerted by VGAM257 gene, herein designated VGAM GENE, on one or more VGAM257 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM257 is inhibition of expression of host target genes, as part of a novel viral mechanism of attacking a host. Accordingly, utilities of VGAM257 include diagnosis, prevention and treatment of viral infection by Vaccinia virus. Specific functions, and accordingly utilities, of VGAM257 correlate with, and may be deduced from, the identity of the host target genes which VGAM257 binds and inhibits, and the function of these host target genes, as elaborated hereinbelow.

Nucleotide sequences of the VGAM257 precursor RNA, herein designated VGAM PRECURSOR RNA, and of the diced VGAM257 RNA, herein designated VGAM RNA, and a schematic representation of the secondary folding of VGAM257 folded precursor RNA, herein designated VGAM FOLDED PRECURSOR RNA, of VGAM257 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM257 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 258 (VGAM258) viral gene, which modulates expression of respective host target genes thereof, the function and utility of which host target genes is known in the art.

VGAM258 is a novel bioinformatically detected regulatory, non protein coding, viral micro RNA (miRNA) gene.

The method by which VGAM258 was detected is described hereinabove with reference to FIGS. 2-8.

VGAM258 gene, herein designated VGAM GENE, is a viral gene contained in the genome of Vaccinia virus. VGAM258 host target gene, herein designated VGAM HOST TARGET GENE, is a human gene contained in the human genome.

VGAM258 gene, herein designated VGAM GENE, encodes a VGAM258 precursor RNA, herein designated VGAM PRECURSOR RNA. Similar to other miRNA genes, and unlike most ordinary genes, VGAM258 precursor RNA, herein designated VGAM PRECURSOR RNA, does not encode a protein. A nucleotide sequence identical or highly similar to the nucleotide sequence of VGAM258 precursor RNA is designated SEQ ID:244, and is provided hereinbelow with reference to the sequence listing part. Nucleotide sequence SEQ ID:244 is located at position 141997 relative to the genome of Vaccinia virus.

VGAM258 precursor RNA, herein designated VGAM PRECURSOR RNA, folds onto itself, forming VGAM258 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM258 folded precursor RNA, herein designated VGAM FOLDED PRECURSOR RNA, into VGAM258 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 88%) nucleotide sequence of VGAM258 RNA is designated SEQ ID:593, and is provided hereinbelow with reference to the sequence listing part.

VGAM258 host target gene, herein designated VGAM HOST TARGET GENE, encodes a corresponding messenger RNA, VGAM258 host target RNA, herein designated VGAM HOST TARGET RNA. VGAM258 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM258 RNA, herein designated VGAM RNA, binds complementarily to one or more host target binding sites located in untranslated regions of VGAM258 host target RNA, herein designated VGAM HOST TARGET RNA. This complementary binding is due to the fact that the nucleotide sequence of VGAM258 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM258 RNA, herein designated VGAM RNA, may have a different number of host target binding sites in untranslated regions of a VGAM258 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM258 RNA, herein designated VGAM RNA, to host target binding sites on VGAM258 host target RNA, herein designated VGAM HOST TARGET RNA, such as BINDING SITE I, BINDING SITE II and BINDING SITE III, inhibits translation of VGAM258 host target RNA, herein designated VGAM HOST TARGET RNA, into VGAM258 host target protein, herein designated VGAM HOST TARGET PROTEIN. VGAM host target protein is therefore outlined by a broken line.

It is appreciated that VGAM258 host target gene, herein designated VGAM HOST TARGET GENE, in fact represents a plurality of VGAM258 host target genes. The mRNA of each one of this plurality of VGAM258 host target genes comprises one or more host target binding sites, each having a nucleotide sequence which is at least partly complementary to VGAM258 RNA, herein designated VGAM RNA, and which when bound by VGAM258 RNA, herein designated VGAM RNA, causes inhibition of translation of respective one or more VGAM258 host target proteins.

It is further appreciated by one skilled in the art that the mode of translational inhibition illustrated by FIG. 1 with specific reference to translational inhibition exerted by VGAM258 gene, herein designated VGAM GENE, on one or more VGAM258 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM258 is inhibition of expression of host target genes, as part of a novel viral mechanism of attacking a host. Accordingly, utilities of VGAM258 include diagnosis, prevention and treatment of viral infection by Vaccinia virus. Specific functions, and accordingly utilities, of VGAM258 correlate with, and may be deduced from, the identity of the host target genes which VGAM258 binds and inhibits, and the function of these host target genes, as elaborated hereinbelow.

Nucleotide sequences of the VGAM258 precursor RNA, herein designated VGAM PRECURSOR RNA, and of the diced VGAM258 RNA, herein designated VGAM RNA, and a schematic representation of the secondary folding of VGAM258 folded precursor RNA, herein designated VGAM FOLDED PRECURSOR RNA, of VGAM258 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM258 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 259 (VGAM259) viral gene, which modulates expression of respective host target genes thereof, the function and utility of which host target genes is known in the art.

VGAM259 is a novel bioinformatically detected regulatory, non protein coding, viral micro RNA (miRNA) gene. The method by which VGAM259 was detected is described hereinabove with reference to FIGS. 2-8.

VGAM259 gene, herein designated VGAM GENE, is a viral gene contained in the genome of Vaccinia virus. VGAM259 host target gene, herein designated VGAM HOST TARGET GENE, is a human gene contained in the human genome.

VGAM259 gene, herein designated VGAM GENE, encodes a VGAM259 precursor RNA, herein designated VGAM PRECURSOR RNA. Similar to other miRNA genes, and unlike most ordinary genes, VGAM259 precursor RNA, herein designated VGAM PRECURSOR RNA, does not encode a protein. A nucleotide sequence identical or highly similar to the nucleotide sequence of VGAM259 precursor RNA is designated SEQ ID:245, and is provided hereinbelow with reference to the sequence listing part. Nucleotide sequence SEQ ID:245 is located at position 144258 relative to the genome of Vaccinia virus.

VGAM259 precursor RNA, herein designated VGAM PRECURSOR RNA, folds onto itself, forming VGAM259 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM259 folded precursor RNA, herein designated VGAM FOLDED PRECURSOR RNA, into VGAM259 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 25%) nucleotide sequence of VGAM259 RNA is designated SEQ ID:594, and is provided hereinbelow with reference to the sequence listing part.

VGAM259 host target gene, herein designated VGAM HOST TARGET GENE, encodes a corresponding messenger RNA, VGAM259 host target RNA, herein designated VGAM HOST TARGET RNA. VGAM259 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM259 RNA, herein designated VGAM RNA, binds complementarily to one or more host target binding sites located in untranslated regions of VGAM259 host target RNA, herein designated VGAM HOST TARGET RNA. This complementary binding is due to the fact that the nucleotide sequence of VGAM259 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM259 RNA, herein designated VGAM RNA, may have a different number of host target binding sites in untranslated regions of a VGAM259 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM259 RNA, herein designated VGAM RNA, to host target binding sites on VGAM259 host target RNA, herein designated VGAM HOST TARGET RNA, such as BINDING SITE I, BINDING SITE II and BINDING SITE III, inhibits translation of VGAM259 host target RNA, herein designated VGAM HOST TARGET RNA, into VGAM259 host target protein, herein designated VGAM HOST TARGET PROTEIN. VGAM host target protein is therefore outlined by a broken line.

It is appreciated that VGAM259 host target gene, herein designated VGAM HOST TARGET GENE, in fact represents a plurality of VGAM259 host target genes. The mRNA of each one of this plurality of VGAM259 host target genes comprises one or more host target binding sites, each having a nucleotide sequence which is at least partly complementary to VGAM259 RNA, herein designated VGAM RNA, and which when bound by VGAM259 RNA, herein designated VGAM RNA, causes inhibition of translation of respective one or more VGAM259 host target proteins.

It is further appreciated by one skilled in the art that the mode of translational inhibition illustrated by FIG. 1 with specific reference to translational inhibition exerted by VGAM259 gene, herein designated VGAM GENE, on one or more VGAM259 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM259 is inhibition of expression of host target genes, as part of a novel viral mechanism of attacking a host. Accordingly, utilities of VGAM259 include diagnosis, prevention and treatment of viral infection by Vaccinia virus. Specific functions, and accordingly utilities, of VGAM259 correlate with, and may be deduced from, the identity of the host target genes which VGAM259 binds and inhibits, and the function of these host target genes, as elaborated hereinbelow.

Nucleotide sequences of the VGAM259 precursor RNA, herein designated VGAM PRECURSOR RNA, and of the diced VGAM259 RNA, herein designated VGAM RNA, and a schematic representation of the secondary folding of VGAM259 folded precursor RNA, herein designated VGAM FOLDED PRECURSOR RNA, of VGAM259 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM259 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 260 (VGAM260) viral gene, which modulates expression of respective host target genes thereof, the function and utility of which host target genes is known in the art.

VGAM260 is a novel bioinformatically detected regulatory, non protein coding, viral micro RNA (miRNA) gene. The method by which VGAM260 was detected is described hereinabove with reference to FIGS. 2-8.

VGAM260 gene, herein designated VGAM GENE, is a viral gene contained in the genome of Vaccinia virus. VGAM260 host target gene, herein designated VGAM HOST TARGET GENE, is a human gene contained in the human genome.

VGAM260 gene, herein designated VGAM GENE, encodes a VGAM260 precursor RNA, herein designated VGAM PRECURSOR RNA. Similar to other miRNA genes, and unlike most ordinary genes, VGAM260 precursor RNA, herein designated VGAM PRECURSOR RNA, does not encode a protein. A nucleotide sequence identical or highly similar to the nucleotide sequence of VGAM260 precursor RNA is designated SEQ ID:246, and is provided hereinbelow with reference to the sequence listing part. Nucleotide sequence SEQ ID:246 is located at position 145827 relative to the genome of Vaccinia virus.

VGAM260 precursor RNA, herein designated VGAM PRECURSOR RNA, folds onto itself, forming VGAM260 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM260 folded precursor RNA, herein designated VGAM FOLDED PRECURSOR RNA, into VGAM260 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 89%) nucleotide sequence of VGAM260 RNA is designated SEQ ID:595, and is provided hereinbelow with reference to the sequence listing part.

VGAM260 host target gene, herein designated VGAM HOST TARGET GENE, encodes a corresponding messenger RNA, VGAM260 host target RNA, herein designated VGAM HOST TARGET RNA. VGAM260 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM260 RNA, herein designated VGAM RNA, binds complementarily to one or more host target binding sites located in untranslated regions of VGAM260 host target RNA, herein designated VGAM HOST TARGET RNA. This complementary binding is due to the fact that the nucleotide sequence of VGAM260 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM260 RNA, herein designated VGAM RNA, may have a different number of host target binding sites in untranslated regions of a VGAM260 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM260 RNA, herein designated VGAM RNA, to host target binding sites on VGAM260 host target RNA, herein designated VGAM HOST TARGET RNA, such as BINDING SITE I, BINDING SITE II and BINDING SITE III, inhibits translation of VGAM260 host target RNA, herein designated VGAM HOST TARGET RNA, into VGAM260 host target protein, herein designated VGAM HOST TARGET PROTEIN. VGAM host target protein is therefore outlined by a broken line.

It is appreciated that VGAM260 host target gene, herein designated VGAM HOST TARGET GENE, in fact represents a plurality of VGAM260 host target genes. The mRNA of each one of this plurality of VGAM260 host target genes comprises one or more host target binding sites, each having a nucleotide sequence which is at least partly complementary to VGAM260 RNA, herein designated VGAM RNA, and which when bound by VGAM260 RNA, herein designated VGAM RNA, causes inhibition of translation of respective one or more VGAM260 host target proteins.

It is further appreciated by one skilled in the art that the mode of translational inhibition illustrated by FIG. 1 with specific reference to translational inhibition exerted by VGAM260 gene, herein designated VGAM GENE, on one or more VGAM260 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM260 is inhibition of expression of host target genes, as part of a novel viral mechanism of attacking a host. Accordingly, utilities of VGAM260 include diagnosis, prevention and treatment of viral infection by Vaccinia virus. Specific functions, and accordingly utilities, of VGAM260 correlate with, and may be deduced from, the identity of the host target genes which VGAM260 binds and inhibits, and the function of these host target genes, as elaborated hereinbelow.

Nucleotide sequences of the VGAM260 precursor RNA, herein designated VGAM PRECURSOR RNA, and of the diced VGAM260 RNA, herein designated VGAM RNA, and a schematic representation of the secondary folding of VGAM260 folded precursor RNA, herein designated VGAM FOLDED PRECURSOR RNA, of VGAM260 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM260 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 261 (VGAM261) viral gene, which modulates expression of respective host target genes thereof, the function and utility of which host target genes is known in the art.

VGAM261 is a novel bioinformatically detected regulatory, non protein coding, viral micro RNA (miRNA) gene. The method by which VGAM261 was detected is described hereinabove with reference to FIGS. 2-8.

VGAM261 gene, herein designated VGAM GENE, is a viral gene contained in the genome of Vaccinia virus. VGAM261 host target gene, herein designated VGAM HOST TARGET GENE, is a human gene contained in the human genome.

VGAM261 gene, herein designated VGAM GENE, encodes a VGAM261 precursor RNA, herein designated VGAM PRECURSOR RNA. Similar to other miRNA genes, and unlike most ordinary genes, VGAM261 precursor RNA, herein designated VGAM PRECURSOR RNA, does not encode a protein. A nucleotide sequence identical or highly similar to the nucleotide sequence of VGAM261 precursor RNA is designated SEQ ID:247, and is provided hereinbelow with reference to the sequence listing part. Nucleotide sequence SEQ ID:247 is located at position 145163 relative to the genome of Vaccinia virus.

VGAM261 precursor RNA, herein designated VGAM PRECURSOR RNA, folds onto itself, forming VGAM261 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM261 folded precursor RNA, herein designated VGAM FOLDED PRECURSOR RNA, into VGAM261 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 78%) nucleotide sequence of VGAM261 RNA is designated SEQ ID:596, and is provided hereinbelow with reference to the sequence listing part.

VGAM261 host target gene, herein designated VGAM HOST TARGET GENE, encodes a corresponding messenger RNA, VGAM261 host target RNA, herein designated VGAM HOST TARGET RNA. VGAM261 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM261 RNA, herein designated VGAM RNA, binds complementarily to one or more host target binding sites located in untranslated regions of VGAM261 host target RNA, herein designated VGAM HOST TARGET RNA. This complementary binding is due to the fact that the nucleotide sequence of VGAM261 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM261 RNA, herein designated VGAM RNA, may have a different number of host target binding sites in untranslated regions of a VGAM261 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM261 RNA, herein designated VGAM RNA, to host target binding sites on VGAM261 host target RNA, herein designated VGAM HOST TARGET RNA, such as BINDING SITE I, BINDING SITE II and BINDING SITE III, inhibits translation of VGAM261 host target RNA, herein designated VGAM HOST TARGET RNA, into VGAM261 host target protein, herein designated VGAM HOST TARGET PROTEIN. VGAM host target protein is therefore outlined by a broken line.

It is appreciated that VGAM261 host target gene, herein designated VGAM HOST TARGET GENE, in fact represents a plurality of VGAM261 host target genes. The mRNA of each one of this plurality of VGAM261 host target genes comprises one or more host target binding sites, each having a nucleotide sequence which is at least partly complementary to VGAM261 RNA, herein designated VGAM RNA, and which when bound by VGAM261 RNA, herein designated VGAM RNA, causes inhibition of translation of respective one or more VGAM261 host target proteins.

It is further appreciated by one skilled in the art that the mode of translational inhibition illustrated by FIG. 1 with specific reference to translational inhibition exerted by VGAM261 gene, herein designated VGAM GENE, on one or more VGAM261 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM261 is inhibition of expression of host target genes, as part of a novel viral mechanism of attacking a host. Accordingly, utilities of VGAM261 include diagnosis, prevention and treatment of viral infection by Vaccinia virus. Specific functions, and accordingly utilities, of VGAM261 correlate with, and may be deduced from, the identity of the host target genes which VGAM261 binds and inhibits, and the function of these host target genes, as elaborated hereinbelow.

Nucleotide sequences of the VGAM261 precursor RNA, herein designated VGAM PRECURSOR RNA, and of the diced VGAM261 RNA, herein designated VGAM RNA, and a schematic representation of the secondary folding of VGAM261 folded precursor RNA, herein designated VGAM FOLDED PRECURSOR RNA, of VGAM261 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM261 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 262 (VGAM262) viral gene, which modulates expression of respective host target genes thereof, the function and utility of which host target genes is known in the art.

VGAM262 is a novel bioinformatically detected regulatory, non protein coding, viral micro RNA (miRNA) gene. The method by which VGAM262 was detected is described hereinabove with reference to FIGS. 2-8.

VGAM262 gene, herein designated VGAM GENE, is a viral gene contained in the genome of Vaccinia virus. VGAM262 host target gene, herein designated VGAM HOST TARGET GENE, is a human gene contained in the human genome.

VGAM262 gene, herein designated VGAM GENE, encodes a VGAM262 precursor RNA, herein designated VGAM PRECURSOR RNA. Similar to other miRNA genes, and unlike most ordinary genes, VGAM262 precursor RNA, herein designated VGAM PRECURSOR RNA, does not encode a protein. A nucleotide sequence identical or highly similar to the nucleotide sequence of VGAM262 precursor RNA is designated SEQ ID:248, and is provided hereinbelow with reference to the sequence listing part. Nucleotide sequence SEQ ID:248 is located at position 147193 relative to the genome of Vaccinia virus.

VGAM262 precursor RNA, herein designated VGAM PRECURSOR RNA, folds onto itself, forming VGAM262 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM262 folded precursor RNA, herein designated VGAM FOLDED PRECURSOR RNA, into VGAM262 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 85%) nucleotide sequence of VGAM262 RNA is designated SEQ ID:597, and is provided hereinbelow with reference to the sequence listing part.

VGAM262 host target gene, herein designated VGAM HOST TARGET GENE, encodes a corresponding messenger RNA, VGAM262 host target RNA, herein designated VGAM HOST TARGET RNA. VGAM262 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM262 RNA, herein designated VGAM RNA, binds complementarily to one or more host target binding sites located in untranslated regions of VGAM262 host target RNA, herein designated VGAM HOST TARGET RNA. This complementary binding is due to the fact that the nucleotide sequence of VGAM262 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM262 RNA, herein designated VGAM RNA, may have a different number of host target binding sites in untranslated regions of a VGAM262 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM262 RNA, herein designated VGAM RNA, to host target binding sites on VGAM262 host target RNA, herein designated VGAM HOST TARGET RNA, such as BINDING SITE I, BINDING SITE II and BINDING SITE III, inhibits translation of VGAM262 host target RNA, herein designated VGAM HOST TARGET RNA, into VGAM262 host target protein, herein designated VGAM HOST TARGET PROTEIN. VGAM host target protein is therefore outlined by a broken line.

It is appreciated that VGAM262 host target gene, herein designated VGAM HOST TARGET GENE, in fact represents a plurality of VGAM262 host target genes. The mRNA of each one of this plurality of VGAM262 host target genes comprises one or more host target binding sites, each having a nucleotide sequence which is at least partly complementary to VGAM262 RNA, herein designated VGAM RNA, and which when bound by VGAM262 RNA, herein designated VGAM RNA, causes inhibition of translation of respective one or more VGAM262 host target proteins.

It is further appreciated by one skilled in the art that the mode of translational inhibition illustrated by FIG. 1 with specific reference to translational inhibition exerted by VGAM262 gene, herein designated VGAM GENE, on one or more VGAM262 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM262 is inhibition of expression of host target genes, as part of a novel viral mechanism of attacking a host. Accordingly, utilities of VGAM262 include diagnosis, prevention and treatment of viral infection by Vaccinia virus. Specific functions, and accordingly utilities, of VGAM262 correlate with, and may be deduced from, the identity of the host target genes which VGAM262 binds and inhibits, and the function of these host target genes, as elaborated hereinbelow.

Nucleotide sequences of the VGAM262 precursor RNA, herein designated VGAM PRECURSOR RNA, and of the diced VGAM262 RNA, herein designated VGAM RNA, and a schematic representation of the secondary folding of VGAM262 folded precursor RNA, herein designated VGAM FOLDED PRECURSOR RNA, of VGAM262 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM262 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 263 (VGAM263) viral gene, which modulates expression of respective host target genes thereof, the function and utility of which host target genes is known in the art.

VGAM263 is a novel bioinformatically detected regulatory, non protein coding, viral micro RNA (miRNA) gene. The method by which VGAM263 was detected is described hereinabove with reference to FIGS. 2-8.

VGAM263 gene, herein designated VGAM GENE, is a viral gene contained in the genome of Vaccinia virus. VGAM263 host target gene, herein designated VGAM HOST TARGET GENE, is a human gene contained in the human genome.

VGAM263 gene, herein designated VGAM GENE, encodes a VGAM263 precursor RNA, herein designated VGAM PRECURSOR RNA. Similar to other miRNA genes, and unlike most ordinary genes, VGAM263 precursor RNA, herein designated VGAM PRECURSOR RNA, does not encode a protein. A nucleotide sequence identical or highly similar to the nucleotide sequence of VGAM263 precursor RNA is designated SEQ ID:249, and is provided hereinbelow with reference to the sequence listing part. Nucleotide sequence SEQ ID:249 is located at position 147919 relative to the genome of Vaccinia virus.

VGAM263 precursor RNA, herein designated VGAM PRECURSOR RNA, folds onto itself, forming VGAM263 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM263 folded precursor RNA, herein designated VGAM FOLDED PRECURSOR RNA, into VGAM263 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM263 RNA is designated SEQ ID:598, and is provided hereinbelow with reference to the sequence listing part.

VGAM263 host target gene, herein designated VGAM HOST TARGET GENE, encodes a corresponding messenger RNA, VGAM263 host target RNA, herein designated VGAM HOST TARGET RNA. VGAM263 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM263 RNA, herein designated VGAM RNA, binds complementarily to one or more host target binding sites located in untranslated regions of VGAM263 host target RNA, herein designated VGAM HOST TARGET RNA. This complementary binding is due to the fact that the nucleotide sequence of VGAM263 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM263 RNA, herein designated VGAM RNA, may have a different number of host target binding sites in untranslated regions of a VGAM263 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM263 RNA, herein designated VGAM RNA, to host target binding sites on VGAM263 host target RNA, herein designated VGAM HOST TARGET RNA, such as BINDING SITE I, BINDING SITE II and BINDING SITE III, inhibits translation of VGAM263 host target RNA, herein designated VGAM HOST TARGET RNA, into VGAM263 host target protein, herein designated VGAM HOST TARGET PROTEIN. VGAM host target protein is therefore outlined by a broken line.

It is appreciated that VGAM263 host target gene, herein designated VGAM HOST TARGET GENE, in fact represents a plurality of VGAM263 host target genes. The mRNA of each one of this plurality of VGAM263 host target genes comprises one or more host target binding sites, each having a nucleotide sequence which is at least partly complementary to VGAM263 RNA, herein designated VGAM RNA, and which when bound by VGAM263 RNA, herein designated VGAM RNA, causes inhibition of translation of respective one or more VGAM263 host target proteins.

It is further appreciated by one skilled in the art that the mode of translational inhibition illustrated by FIG. 1 with specific reference to translational inhibition exerted by VGAM263 gene, herein designated VGAM GENE, on one or more VGAM263 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM263 is inhibition of expression of host target genes, as part of a novel viral mechanism of attacking a host. Accordingly, utilities of VGAM263 include diagnosis, prevention and treatment of viral infection by Vaccinia virus. Specific functions, and accordingly utilities, of VGAM263 correlate with, and may be deduced from, the identity of the host target genes which VGAM263 binds and inhibits, and the function of these host target genes, as elaborated hereinbelow.

Nucleotide sequences of the VGAM263 precursor RNA, herein designated VGAM PRECURSOR RNA, and of the diced VGAM263 RNA, herein designated VGAM RNA, and a schematic representation of the secondary folding of VGAM263 folded precursor RNA, herein designated VGAM FOLDED PRECURSOR RNA, of VGAM263 are further described hereinbelow with reference to Table 1.

Nucleotide sequences of host target binding sites, such as BINDING SITE-I, BINDING SITE-II and BINDING SITE- III of FIG. 1, found on, and schematic representation of the complementarity of each of these host target binding sites to VGAM263 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 264 (VGAM264) viral gene, which modulates expression of respective host target genes thereof, the function and utility of which host target genes is known in the art.

VGAM264 is a novel bioinformatically detected regulatory, non protein coding, viral micro RNA (miRNA) gene. The method by which VGAM264 was detected is described hereinabove with reference to FIGS. 2-8.

VGAM264 gene, herein designated VGAM GENE, is a viral gene contained in the genome of Vaccinia virus. VGAM264 host target gene, herein designated VGAM HOST TARGET GENE, is a human gene contained in the human genome.

VGAM264 gene, herein designated VGAM GENE, encodes a VGAM264 precursor RNA, herein designated VGAM PRECURSOR RNA. Similar to other miRNA genes, and unlike most ordinary genes, VGAM264 precursor RNA, herein designated VGAM PRECURSOR RNA, does not encode a protein. A nucleotide sequence identical or highly similar to the nucleotide sequence of VGAM264 precursor RNA is designated SEQ ID:250, and is provided hereinbelow with reference to the sequence listing part. Nucleotide sequence SEQ ID:250 is located at position 148297 relative to the genome of Vaccinia virus.

VGAM264 precursor RNA, herein designated VGAM PRECURSOR RNA, folds onto itself, forming VGAM264 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM264 folded precursor RNA, herein designated VGAM FOLDED PRECURSOR RNA, into VGAM264 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 87%) nucleotide sequence of VGAM264 RNA is designated SEQ ID:599, and is provided hereinbelow with reference to the sequence listing part.

VGAM264 host target gene, herein designated VGAM HOST TARGET GENE, encodes a corresponding messenger RNA, VGAM264 host target RNA, herein designated VGAM HOST TARGET RNA. VGAM264 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM264 RNA, herein designated VGAM RNA, binds complementarily to one or more host target binding sites located in untranslated regions of VGAM264 host target RNA, herein designated VGAM HOST TARGET RNA. This complementary binding is due to the fact that the nucleotide sequence of VGAM264 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM264 RNA, herein designated VGAM RNA, may have a different number of host target binding sites in untranslated regions of a VGAM264 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM264 RNA, herein designated VGAM RNA, to host target binding sites on VGAM264 host target RNA, herein designated VGAM HOST TARGET RNA, such as BINDING SITE I, BINDING SITE II and BINDING SITE III, inhibits translation of VGAM264 host target RNA, herein designated VGAM HOST TARGET RNA, into VGAM264 host target protein, herein designated VGAM HOST TARGET PROTEIN. VGAM host target protein is therefore outlined by a broken line.

It is appreciated that VGAM264 host target gene, herein designated VGAM HOST TARGET GENE, in fact represents a plurality of VGAM264 host target genes. The mRNA of each one of this plurality of VGAM264 host target genes comprises one or more host target binding sites, each having a nucleotide sequence which is at least partly complementary to VGAM264 RNA, herein designated VGAM RNA, and which when bound by VGAM264 RNA, herein designated VGAM RNA, causes inhibition of translation of respective one or more VGAM264 host target proteins.

It is further appreciated by one skilled in the art that the mode of translational inhibition illustrated by FIG. 1 with specific reference to translational inhibition exerted by VGAM264 gene, herein designated VGAM GENE, on one or more VGAM264 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM264 is inhibition of expression of host target genes, as part of a novel viral mechanism of attacking a host. Accordingly, utilities of VGAM264 include diagnosis, prevention and treatment of viral infection by Vaccinia virus. Specific functions, and accordingly utilities, of VGAM264 correlate with, and may be deduced from, the identity of the host target genes which VGAM264 binds and inhibits, and the function of these host target genes, as elaborated hereinbelow.

Nucleotide sequences of the VGAM264 precursor RNA, herein designated VGAM PRECURSOR RNA, and of the diced VGAM264 RNA, herein designated VGAM RNA, and a schematic representation of the secondary folding of VGAM264 folded precursor RNA, herein designated VGAM FOLDED PRECURSOR RNA, of VGAM264 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM264 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 265 (VGAM265) viral gene, which modulates expression of respective host target genes thereof, the function and utility of which host target genes is known in the art.

VGAM265 is a novel bioinformatically detected regulatory, non protein coding, viral micro RNA (miRNA) gene. The method by which VGAM265 was detected is described hereinabove with reference to FIGS. 2-8.

VGAM265 gene, herein designated VGAM GENE, is a viral gene contained in the genome of Vaccinia virus. VGAM265 host target gene, herein designated VGAM HOST TARGET GENE, is a human gene contained in the human genome.

VGAM265 gene, herein designated VGAM GENE, encodes a VGAM265 precursor RNA, herein designated VGAM PRECURSOR RNA. Similar to other miRNA genes, and unlike most ordinary genes, VGAM265 precursor RNA, herein designated VGAM PRECURSOR RNA, does not encode a protein. A nucleotide sequence identical or highly similar to the nucleotide sequence of VGAM265 precursor RNA is designated SEQ ID:251, and is provided hereinbelow with reference to the sequence listing part. Nucleotide sequence SEQ ID:251 is located at position 148003 relative to the genome of Vaccinia virus.

VGAM265 precursor RNA, herein designated VGAM PRECURSOR RNA, folds onto itself, forming VGAM265 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM265 folded precursor RNA, herein designated VGAM FOLDED PRECURSOR RNA, into VGAM265 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 86%) nucleotide sequence of VGAM265 RNA is designated SEQ ID:600, and is provided hereinbelow with reference to the sequence listing part.

VGAM265 host target gene, herein designated VGAM HOST TARGET GENE, encodes a corresponding messenger RNA, VGAM265 host target RNA, herein designated VGAM HOST TARGET RNA. VGAM265 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM265 RNA, herein designated VGAM RNA, binds complementarily to one or more host target binding sites located in untranslated regions of VGAM265 host target RNA, herein designated VGAM HOST TARGET RNA. This complementary binding is due to the fact that the nucleotide sequence of VGAM265 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM265 RNA, herein designated VGAM RNA, may have a different number of host target binding sites in untranslated regions of a VGAM265 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM265 RNA, herein designated VGAM RNA, to host target binding sites on VGAM265 host target RNA, herein designated VGAM HOST TARGET RNA, such as BINDING SITE I, BINDING SITE II and BINDING SITE III, inhibits translation of VGAM265 host target RNA, herein designated VGAM HOST TARGET RNA, into VGAM265 host target protein, herein designated VGAM HOST TARGET PROTEIN. VGAM host target protein is therefore outlined by a broken line.

It is appreciated that VGAM265 host target gene, herein designated VGAM HOST TARGET GENE, in fact represents a plurality of VGAM265 host target genes. The mRNA of each one of this plurality of VGAM265 host target genes comprises one or more host target binding sites, each having a nucleotide sequence which is at least partly complementary to VGAM265 RNA, herein designated VGAM RNA, and which when bound by VGAM265 RNA, herein designated VGAM RNA, causes inhibition of translation of respective one or more VGAM265 host target proteins.

It is further appreciated by one skilled in the art that the mode of translational inhibition illustrated by FIG. 1 with specific reference to translational inhibition exerted by VGAM265 gene, herein designated VGAM GENE, on one or more VGAM265 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM265 is inhibition of expression of host target genes, as part of a novel viral mechanism of attacking a host. Accordingly, utilities of VGAM265 include diagnosis, prevention and treatment of viral infection by Vaccinia virus. Specific functions, and accordingly utilities, of VGAM265 correlate with, and may be deduced from, the identity of the host target genes which VGAM265 binds and inhibits, and the function of these host target genes, as elaborated hereinbelow.

Nucleotide sequences of the VGAM265 precursor RNA, herein designated VGAM PRECURSOR RNA, and of the diced VGAM265 RNA, herein designated VGAM RNA, and a schematic representation of the secondary folding of VGAM265 folded precursor RNA, herein designated VGAM FOLDED PRECURSOR RNA, of VGAM265 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM265 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 266 (VGAM266) viral gene, which modulates expression of respective host target genes thereof, the function and utility of which host target genes is known in the art.

VGAM266 is a novel bioinformatically detected regulatory, non protein coding, viral micro RNA (miRNA) gene. The method by which VGAM266 was detected is described hereinabove with reference to FIGS. 2-8.

VGAM266 gene, herein designated VGAM GENE, is a viral gene contained in the genome of Vaccinia virus. VGAM266 host target gene, herein designated VGAM HOST TARGET GENE, is a human gene contained in the human genome.

VGAM266 gene, herein designated VGAM GENE, encodes a VGAM266 precursor RNA, herein designated VGAM PRECURSOR RNA. Similar to other miRNA genes, and unlike most ordinary genes, VGAM266 precursor RNA, herein designated VGAM PRECURSOR RNA, does not encode a protein. A nucleotide sequence identical or highly similar to the nucleotide sequence of VGAM266 precursor RNA is designated SEQ ID:252, and is provided hereinbelow with reference to the sequence listing part. Nucleotide sequence SEQ ID:252 is located at position 149215 relative to the genome of Vaccinia virus.

VGAM266 precursor RNA, herein designated VGAM PRECURSOR RNA, folds onto itself, forming VGAM266 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM266 folded precursor RNA, herein designated VGAM FOLDED PRECURSOR RNA, into VGAM266 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 86%) nucleotide sequence of VGAM266 RNA is designated SEQ ID:601, and is provided hereinbelow with reference to the sequence listing part.

VGAM266 host target gene, herein designated VGAM HOST TARGET GENE, encodes a corresponding messenger RNA, VGAM266 host target RNA, herein designated VGAM HOST TARGET RNA. VGAM266 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM266 RNA, herein designated VGAM RNA, binds complementarily to one or more host target binding sites located in untranslated regions of VGAM266 host target RNA, herein designated VGAM HOST TARGET RNA. This complementary binding is due to the fact that the nucleotide sequence of VGAM266 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM266 RNA, herein designated VGAM RNA, may have a different number of host target binding sites in untranslated regions of a VGAM266 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM266 RNA, herein designated VGAM RNA, to host target binding sites on VGAM266 host target RNA, herein designated VGAM HOST TARGET RNA, such as BINDING SITE I, BINDING SITE II and BINDING SITE III, inhibits translation of VGAM266 host target RNA, herein designated VGAM HOST TARGET RNA, into VGAM266 host target protein, herein designated VGAM HOST TARGET PROTEIN. VGAM host target protein is therefore outlined by a broken line.

It is appreciated that VGAM266 host target gene, herein designated VGAM HOST TARGET GENE, in fact represents a plurality of VGAM266 host target genes. The mRNA of each one of this plurality of VGAM266 host target genes comprises one or more host target binding sites, each having a nucleotide sequence which is at least partly complementary to VGAM266 RNA, herein designated VGAM RNA, and which when bound by VGAM266 RNA, herein designated VGAM RNA, causes inhibition of translation of respective one or more VGAM266 host target proteins.

It is further appreciated by one skilled in the art that the mode of translational inhibition illustrated by FIG. 1 with specific reference to translational inhibition exerted by VGAM266 gene, herein designated VGAM GENE, on one or more VGAM266 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM266 is inhibition of expression of host target genes, as part of a novel viral mechanism of attacking a host. Accordingly, utilities of VGAM266 include diagnosis, prevention and treatment of viral infection by Vaccinia virus. Specific functions, and accordingly utilities, of VGAM266 correlate with, and may be deduced from, the identity of the host target genes which VGAM266 binds and inhibits, and the function of these host target genes, as elaborated hereinbelow.

Nucleotide sequences of the VGAM266 precursor RNA, herein designated VGAM PRECURSOR RNA, and of the diced VGAM266 RNA, herein designated VGAM RNA, and a schematic representation of the secondary folding of VGAM266 folded precursor RNA, herein designated VGAM FOLDED PRECURSOR RNA, of VGAM266 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM266 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 267 (VGAM267) viral gene, which modulates expression of respective host target genes thereof, the function and utility of which host target genes is known in the art.

VGAM267 is a novel bioinformatically detected regulatory, non protein coding, viral micro RNA (miRNA) gene. The method by which VGAM267 was detected is described hereinabove with reference to FIGS. 2-8.

VGAM267 gene, herein designated VGAM GENE, is a viral gene contained in the genome of Vaccinia virus. VGAM267 host target gene, herein designated VGAM HOST TARGET GENE, is a human gene contained in the human genome.

VGAM267 gene, herein designated VGAM GENE, encodes a VGAM267 precursor RNA, herein designated VGAM PRECURSOR RNA. Similar to other miRNA genes, and unlike most ordinary genes, VGAM267 precursor RNA, herein designated VGAM PRECURSOR RNA, does not encode a protein. A nucleotide sequence identical or highly similar to the nucleotide sequence of VGAM267 precursor RNA is designated SEQ ID:253, and is provided hereinbelow with reference to the sequence listing part. Nucleotide sequence SEQ ID:253 is located at position 148793 relative to the genome of Vaccinia virus.

VGAM267 precursor RNA, herein designated VGAM PRECURSOR RNA, folds onto itself, forming VGAM267 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM267 folded precursor RNA, herein designated VGAM FOLDED PRECURSOR RNA, into VGAM267 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 91%) nucleotide sequence of VGAM267 RNA is designated SEQ ID:602, and is provided hereinbelow with reference to the sequence listing part.

VGAM267 host target gene, herein designated VGAM HOST TARGET GENE, encodes a corresponding messenger RNA, VGAM267 host target RNA, herein designated VGAM HOST TARGET RNA. VGAM267 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM267 RNA, herein designated VGAM RNA, binds complementarily to one or more host target binding sites located in untranslated regions of VGAM267 host target RNA, herein designated VGAM HOST TARGET RNA. This complementary binding is due to the fact that the nucleotide sequence of VGAM267 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM267 RNA, herein designated VGAM RNA, may have a different number of host target binding sites in untranslated regions of a VGAM267 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM267 RNA, herein designated VGAM RNA, to host target binding sites on VGAM267 host target RNA, herein designated VGAM HOST TARGET RNA, such as BINDING SITE I, BINDING SITE II and BINDING SITE III, inhibits translation of VGAM267 host target RNA, herein designated VGAM HOST TARGET RNA, into VGAM267 host target protein, herein designated VGAM HOST TARGET PROTEIN. VGAM host target protein is therefore outlined by a broken line.

It is appreciated that VGAM267 host target gene, herein designated VGAM HOST TARGET GENE, in fact represents a plurality of VGAM267 host target genes. The mRNA of each one of this plurality of VGAM267 host target genes comprises one or more host target binding sites, each having a nucleotide sequence which is at least partly complementary to VGAM267 RNA, herein designated VGAM RNA, and which when bound by VGAM267 RNA, herein designated VGAM RNA, causes inhibition of translation of respective one or more VGAM267 host target proteins.

It is further appreciated by one skilled in the art that the mode of translational inhibition illustrated by FIG. 1 with specific reference to translational inhibition exerted by VGAM267 gene, herein designated VGAM GENE, on one or more VGAM267 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM267 is inhibition of expression of host target genes, as part of a novel viral mechanism of attacking a host. Accordingly, utilities of VGAM267 include diagnosis, prevention and treatment of viral infection by Vaccinia virus. Specific functions, and accordingly utilities, of VGAM267 correlate with, and may be deduced from, the identity of the host target genes which VGAM267 binds and inhibits, and the function of these host target genes, as elaborated hereinbelow.

Nucleotide sequences of the VGAM267 precursor RNA, herein designated VGAM PRECURSOR RNA, and of the diced VGAM267 RNA, herein designated VGAM RNA, and a schematic representation of the secondary folding of VGAM267 folded precursor RNA, herein designated VGAM FOLDED PRECURSOR RNA, of VGAM267 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM267 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 268 (VGAM268) viral gene, which modulates expression of respective host target genes thereof, the function and utility of which host target genes is known in the art.

VGAM268 is a novel bioinformatically detected regulatory, non protein coding, viral micro RNA (miRNA) gene. The method by which VGAM268 was detected is described hereinabove with reference to FIGS. 2-8.

VGAM268 gene, herein designated VGAM GENE, is a viral gene contained in the genome of Vaccinia virus. VGAM268 host target gene, herein designated VGAM HOST TARGET GENE, is a human gene contained in the human genome.

VGAM268 gene, herein designated VGAM GENE, encodes a VGAM268 precursor RNA, herein designated VGAM PRECURSOR RNA. Similar to other miRNA genes, and unlike most ordinary genes, VGAM268 precursor RNA, herein designated VGAM PRECURSOR RNA, does not encode a protein. A nucleotide sequence identical or highly similar to the nucleotide sequence of VGAM268 precursor RNA is designated SEQ ID:254, and is provided hereinbelow with reference to the sequence listing part. Nucleotide sequence SEQ ID:254 is located at position 153199 relative to the genome of Vaccinia virus.

VGAM268 precursor RNA, herein designated VGAM PRECURSOR RNA, folds onto itself, forming VGAM268 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM268 folded precursor RNA, herein designated VGAM FOLDED PRECURSOR RNA, into VGAM268 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 78%) nucleotide sequence of VGAM268 RNA is designated SEQ ID:603, and is provided hereinbelow with reference to the sequence listing part.

VGAM268 host target gene, herein designated VGAM HOST TARGET GENE, encodes a corresponding messenger RNA, VGAM268 host target RNA, herein designated VGAM HOST TARGET RNA. VGAM268 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM268 RNA, herein designated VGAM RNA, binds complementarily to one or more host target binding sites located in untranslated regions of VGAM268 host target RNA, herein designated VGAM HOST TARGET RNA. This complementary binding is due to the fact that the nucleotide sequence of VGAM268 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM268 RNA, herein designated VGAM RNA, may have a different number of host target binding sites in untranslated regions of a VGAM268 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM268 RNA, herein designated VGAM RNA, to host target binding sites on VGAM268 host target RNA, herein designated VGAM HOST TARGET RNA, such as BINDING SITE I, BINDING SITE II and BINDING SITE III, inhibits translation of VGAM268 host target RNA, herein designated VGAM HOST TARGET RNA, into VGAM268 host target protein, herein designated VGAM HOST TARGET PROTEIN. VGAM host target protein is therefore outlined by a broken line.

It is appreciated that VGAM268 host target gene, herein designated VGAM HOST TARGET GENE, in fact represents a plurality of VGAM268 host target genes. The mRNA of each one of this plurality of VGAM268 host target genes comprises one or more host target binding sites, each having a nucleotide sequence which is at least partly complementary to VGAM268 RNA, herein designated VGAM RNA, and which when bound by VGAM268 RNA, herein designated VGAM RNA, causes inhibition of translation of respective one or more VGAM268 host target proteins.

It is further appreciated by one skilled in the art that the mode of translational inhibition illustrated by FIG. 1 with specific reference to translational inhibition exerted by VGAM268 gene, herein designated VGAM GENE, on one or more VGAM268 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM268 is inhibition of expression of host target genes, as part of a novel viral mechanism of attacking a host. Accordingly, utilities of VGAM268 include diagnosis, prevention and treatment of viral infection by Vaccinia virus. Specific functions, and accordingly utilities, of VGAM268 correlate with, and may be deduced from, the identity of the host target genes which VGAM268 binds and inhibits, and the function of these host target genes, as elaborated hereinbelow.

Nucleotide sequences of the VGAM268 precursor RNA, herein designated VGAM PRECURSOR RNA, and of the diced VGAM268 RNA, herein designated VGAM RNA, and a schematic representation of the secondary folding of VGAM268 folded precursor RNA, herein designated VGAM FOLDED PRECURSOR RNA, of VGAM268 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM268 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 269 (VGAM269) viral gene, which modulates expression of respective host target genes thereof, the function and utility of which host target genes is known in the art.

VGAM269 is a novel bioinformatically detected regulatory, non protein coding, viral micro RNA (miRNA) gene. The method by which VGAM269 was detected is described hereinabove with reference to FIGS. 2-8.

VGAM269 gene, herein designated VGAM GENE, is a viral gene contained in the genome of Vaccinia virus. VGAM269 host target gene, herein designated VGAM HOST TARGET GENE, is a human gene contained in the human genome.

VGAM269 gene, herein designated VGAM GENE, encodes a VGAM269 precursor RNA, herein designated VGAM PRECURSOR RNA. Similar to other miRNA genes, and unlike most ordinary genes, VGAM269 precursor RNA, herein designated VGAM PRECURSOR RNA, does not encode a protein. A nucleotide sequence identical or highly similar to the nucleotide sequence of VGAM269 precursor RNA is designated SEQ ID:255, and is provided hereinbelow with reference to the sequence listing part. Nucleotide sequence SEQ ID:255 is located at position 153361 relative to the genome of Vaccinia virus.

VGAM269 precursor RNA, herein designated VGAM PRECURSOR RNA, folds onto itself, forming VGAM269 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM269 folded precursor RNA, herein designated VGAM FOLDED PRECURSOR RNA, into VGAM269 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 86%) nucleotide sequence of VGAM269 RNA is designated SEQ ID:604, and is provided hereinbelow with reference to the sequence listing part.

VGAM269 host target gene, herein designated VGAM HOST TARGET GENE, encodes a corresponding messenger RNA, VGAM269 host target RNA, herein designated VGAM HOST TARGET RNA. VGAM269 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM269 RNA, herein designated VGAM RNA, binds complementarily to one or more host target binding sites located in untranslated regions of VGAM269 host target RNA, herein designated VGAM HOST TARGET RNA. This complementary binding is due to the fact that the nucleotide sequence of VGAM269 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM269 RNA, herein designated VGAM RNA, may have a different number of host target binding sites in untranslated regions of a VGAM269 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM269 RNA, herein designated VGAM RNA, to host target binding sites on VGAM269 host target RNA, herein designated VGAM HOST TARGET RNA, such as BINDING SITE I, BINDING SITE II and BINDING SITE III, inhibits translation of VGAM269 host target RNA, herein designated VGAM HOST TARGET RNA, into VGAM269 host target protein, herein designated VGAM HOST TARGET PROTEIN. VGAM host target protein is therefore outlined by a broken line.

It is appreciated that VGAM269 host target gene, herein designated VGAM HOST TARGET GENE, in fact represents a plurality of VGAM269 host target genes. The mRNA of each one of this plurality of VGAM269 host target genes comprises one or more host target binding sites, each having a nucleotide sequence which is at least partly complementary to VGAM269 RNA, herein designated VGAM RNA, and which when bound by VGAM269 RNA, herein designated VGAM RNA, causes inhibition of translation of respective one or more VGAM269 host target proteins.

It is further appreciated by one skilled in the art that the mode of translational inhibition illustrated by FIG. 1 with specific reference to translational inhibition exerted by VGAM269 gene, herein designated VGAM GENE, on one or more VGAM269 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM269 is inhibition of expression of host target genes, as part of a novel viral mechanism of attacking a host. Accordingly, utilities of VGAM269 include diagnosis, prevention and treatment of viral infection by Vaccinia virus. Specific functions, and accordingly utilities, of VGAM269 correlate with, and may be deduced from, the identity of the host target genes which VGAM269 binds and inhibits, and the function of these host target genes, as elaborated hereinbelow.

Nucleotide sequences of the VGAM269 precursor RNA, herein designated VGAM PRECURSOR RNA, and of the diced VGAM269 RNA, herein designated VGAM RNA, and a schematic representation of the secondary folding of VGAM269 folded precursor RNA, herein designated VGAM FOLDED PRECURSOR RNA, of VGAM269 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM269 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 270 (VGAM270) viral gene, which modulates expression of respective host target genes thereof, the function and utility of which host target genes is known in the art.

VGAM270 is a novel bioinformatically detected regulatory, non protein coding, viral micro RNA (miRNA) gene. The method by which VGAM270 was detected is described hereinabove with reference to FIGS. 2-8.

VGAM270 gene, herein designated VGAM GENE, is a viral gene contained in the genome of Vaccinia virus. VGAM270 host target gene, herein designated VGAM HOST TARGET GENE, is a human gene contained in the human genome.

VGAM270 gene, herein designated VGAM GENE, encodes a VGAM270 precursor RNA, herein designated VGAM PRECURSOR RNA. Similar to other miRNA genes, and unlike most ordinary genes, VGAM270 precursor RNA, herein designated VGAM PRECURSOR RNA, does not encode a protein. A nucleotide sequence identical or highly similar to the nucleotide sequence of VGAM270 precursor RNA is designated SEQ ID:256, and is provided hereinbelow with reference to the sequence listing part. Nucleotide sequence SEQ ID:256 is located at position 153717 relative to the genome of Vaccinia virus.

VGAM270 precursor RNA, herein designated VGAM PRECURSOR RNA, folds onto itself, forming VGAM270 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM270 folded precursor RNA, herein designated VGAM FOLDED PRECURSOR RNA, into VGAM270 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM270 RNA is designated SEQ ID:605, and is provided hereinbelow with reference to the sequence listing part.

VGAM270 host target gene, herein designated VGAM HOST TARGET GENE, encodes a corresponding messenger RNA, VGAM270 host target RNA, herein designated VGAM HOST TARGET RNA. VGAM270 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM270 RNA, herein designated VGAM RNA, binds complementarily to one or more host target binding sites located in untranslated regions of VGAM270 host target RNA, herein designated VGAM HOST TARGET RNA. This complementary binding is due to the fact that the nucleotide sequence of VGAM270 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM270 RNA, herein designated VGAM RNA, may have a different number of host target binding sites in untranslated regions of a VGAM270 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM270 RNA, herein designated VGAM RNA, to host target binding sites on VGAM270 host target RNA, herein designated VGAM HOST TARGET RNA, such as BINDING SITE I, BINDING SITE II and BINDING SITE III, inhibits translation of VGAM270 host target RNA, herein designated VGAM HOST TARGET RNA, into VGAM270 host target protein, herein designated VGAM HOST TARGET PROTEIN. VGAM host target protein is therefore outlined by a broken line.

It is appreciated that VGAM270 host target gene, herein designated VGAM HOST TARGET GENE, in fact represents a plurality of VGAM270 host target genes. The mRNA of each one of this plurality of VGAM270 host target genes comprises one or more host target binding sites, each having a nucleotide sequence which is at least partly complementary to VGAM270 RNA, herein designated VGAM RNA, and which when bound by VGAM270 RNA, herein designated VGAM RNA, causes inhibition of translation of respective one or more VGAM270 host target proteins.

It is further appreciated by one skilled in the art that the mode of translational inhibition illustrated by FIG. 1 with specific reference to translational inhibition exerted by VGAM270 gene, herein designated VGAM GENE, on one or more VGAM270 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM270 is inhibition of expression of host target genes, as part of a novel viral mechanism of attacking a host. Accordingly, utilities of VGAM270 include diagnosis, prevention and treatment of viral infection by Vaccinia virus. Specific functions, and accordingly utilities, of VGAM270 correlate with, and may be deduced from, the identity of the host target genes which VGAM270 binds and inhibits, and the function of these host target genes, as elaborated hereinbelow.

Nucleotide sequences of the VGAM270 precursor RNA, herein designated VGAM PRECURSOR RNA, and of the diced VGAM270 RNA, herein designated VGAM RNA, and a schematic representation of the secondary folding of VGAM270 folded precursor RNA, herein designated VGAM FOLDED PRECURSOR RNA, of VGAM270 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM270 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 271 (VGAM271) viral gene, which modulates expression of respective host target genes thereof, the function and utility of which host target genes is known in the art.

VGAM271 is a novel bioinformatically detected regulatory, non protein coding, viral micro RNA (miRNA) gene. The method by which VGAM271 was detected is described hereinabove with reference to FIGS. 2-8.

VGAM271 gene, herein designated VGAM GENE, is a viral gene contained in the genome of Vaccinia virus. VGAM271 host target gene, herein designated VGAM HOST TARGET GENE, is a human gene contained in the human genome.

VGAM271 gene, herein designated VGAM GENE, encodes a VGAM271 precursor RNA, herein designated VGAM PRECURSOR RNA. Similar to other miRNA genes, and unlike most ordinary genes, VGAM271 precursor RNA, herein designated VGAM PRECURSOR RNA, does not encode a protein. A nucleotide sequence identical or highly similar to the nucleotide sequence of VGAM271 precursor RNA is designated SEQ ID:257, and is provided hereinbelow with reference to the sequence listing part. Nucleotide sequence SEQ ID:257 is located at position 152876 relative to the genome of Vaccinia virus.

VGAM271 precursor RNA, herein designated VGAM PRECURSOR RNA, folds onto itself, forming VGAM271 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM271 folded precursor RNA, herein designated VGAM FOLDED PRECURSOR RNA, into VGAM271 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 72%) nucleotide sequence of VGAM271 RNA is designated SEQ ID:606, and is provided hereinbelow with reference to the sequence listing part.

VGAM271 host target gene, herein designated VGAM HOST TARGET GENE, encodes a corresponding messenger RNA, VGAM271 host target RNA, herein designated VGAM HOST TARGET RNA. VGAM271 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM271 RNA, herein designated VGAM RNA, binds complementarily to one or more host target binding sites located in untranslated regions of VGAM271 host target RNA, herein designated VGAM HOST TARGET RNA. This complementary binding is due to the fact that the nucleotide sequence of VGAM271 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM271 RNA, herein designated VGAM RNA, may have a different number of host target binding sites in untranslated regions of a VGAM271 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM271 RNA, herein designated VGAM RNA, to host target binding sites on VGAM271 host target RNA, herein designated VGAM HOST TARGET RNA, such as BINDING SITE I, BINDING SITE II and BINDING SITE III, inhibits translation of VGAM271 host target RNA, herein designated VGAM HOST TARGET RNA, into VGAM271 host target protein, herein designated VGAM HOST TARGET PROTEIN. VGAM host target protein is therefore outlined by a broken line.

It is appreciated that VGAM271 host target gene, herein designated VGAM HOST TARGET GENE, in fact represents a plurality of VGAM271 host target genes. The mRNA of each one of this plurality of VGAM271 host target genes comprises one or more host target binding sites, each having a nucleotide sequence which is at least partly complementary to VGAM271 RNA, herein designated VGAM RNA, and which when bound by VGAM271 RNA, herein designated VGAM RNA, causes inhibition of translation of respective one or more VGAM271 host target proteins.

It is further appreciated by one skilled in the art that the mode of translational inhibition illustrated by FIG. 1 with specific reference to translational inhibition exerted by VGAM271 gene, herein designated VGAM GENE, on one or more VGAM271 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM271 is inhibition of expression of host target genes, as part of a novel viral mechanism of attacking a host. Accordingly, utilities of VGAM271 include diagnosis, prevention and treatment of viral infection by Vaccinia virus. Specific functions, and accordingly utilities, of VGAM271 correlate with, and may be deduced from, the identity of the host target genes which VGAM271 binds and inhibits, and the function of these host target genes, as elaborated hereinbelow.

Nucleotide sequences of the VGAM271 precursor RNA, herein designated VGAM PRECURSOR RNA, and of the diced VGAM271 RNA, herein designated VGAM RNA, and a schematic representation of the secondary folding of VGAM271 folded precursor RNA, herein designated VGAM FOLDED PRECURSOR RNA, of VGAM271 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM271 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 272 (VGAM272) viral gene, which modulates expression of respective host target genes thereof, the function and utility of which host target genes is known in the art.

VGAM272 is a novel bioinformatically detected regulatory, non protein coding, viral micro RNA (miRNA) gene. The method by which VGAM272 was detected is described hereinabove with reference to FIGS. 2-8.

VGAM272 gene, herein designated VGAM GENE, is a viral gene contained in the genome of Vaccinia virus. VGAM272 host target gene, herein designated VGAM HOST TARGET GENE, is a human gene contained in the human genome.

VGAM272 gene, herein designated VGAM GENE, encodes a VGAM272 precursor RNA, herein designated VGAM PRECURSOR RNA. Similar to other miRNA genes, and unlike most ordinary genes, VGAM272 precursor RNA, herein designated VGAM PRECURSOR RNA, does not encode a protein. A nucleotide sequence identical or highly similar to the nucleotide sequence of VGAM272 precursor RNA is designated SEQ ID:258, and is provided hereinbelow with reference to the sequence listing part. Nucleotide sequence SEQ ID:258 is located at position 154919 relative to the genome of Vaccinia virus.

VGAM272 precursor RNA, herein designated VGAM PRECURSOR RNA, folds onto itself, forming VGAM272 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM272 folded precursor RNA, herein designated VGAM FOLDED PRECURSOR RNA, into VGAM272 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 72%) nucleotide sequence of VGAM272 RNA is designated SEQ ID:607, and is provided hereinbelow with reference to the sequence listing part.

VGAM272 host target gene, herein designated VGAM HOST TARGET GENE, encodes a corresponding messenger RNA, VGAM272 host target RNA, herein designated VGAM HOST TARGET RNA. VGAM272 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM272 RNA, herein designated VGAM RNA, binds complementarily to one or more host target binding sites located in untranslated regions of VGAM272 host target RNA, herein designated VGAM HOST TARGET RNA. This complementary binding is due to the fact that the nucleotide sequence of VGAM272 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM272 RNA, herein designated VGAM RNA, may have a different number of host target binding sites in untranslated regions of a VGAM272 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM272 RNA, herein designated VGAM RNA, to host target binding sites on VGAM272 host target RNA, herein designated VGAM HOST TARGET RNA, such as BINDING SITE I, BINDING SITE II and BINDING SITE III, inhibits translation of VGAM272 host target RNA, herein designated VGAM HOST TARGET RNA, into VGAM272 host target protein, herein designated VGAM HOST TARGET PROTEIN. VGAM host target protein is therefore outlined by a broken line.

It is appreciated that VGAM272 host target gene, herein designated VGAM HOST TARGET GENE, in fact represents a plurality of VGAM272 host target genes. The mRNA of each one of this plurality of VGAM272 host target genes comprises one or more host target binding sites, each having a nucleotide sequence which is at least partly complementary to VGAM272 RNA, herein designated VGAM RNA, and which when bound by VGAM272 RNA, herein designated VGAM RNA, causes inhibition of translation of respective one or more VGAM272 host target proteins.

It is further appreciated by one skilled in the art that the mode of translational inhibition illustrated by FIG. 1 with specific reference to translational inhibition exerted by VGAM272 gene, herein designated VGAM GENE, on one or more VGAM272 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM272 is inhibition of expression of host target genes, as part of a novel viral mechanism of attacking a host. Accordingly, utilities of VGAM272 include diagnosis, prevention and treatment of viral infection by Vaccinia virus. Specific functions, and accordingly utilities, of VGAM272 correlate with, and may be deduced from, the identity of the host target genes which VGAM272 binds and inhibits, and the function of these host target genes, as elaborated hereinbelow.

Nucleotide sequences of the VGAM272 precursor RNA, herein designated VGAM PRECURSOR RNA, and of the diced VGAM272 RNA, herein designated VGAM RNA, and a schematic representation of the secondary folding of VGAM272 folded precursor RNA, herein designated VGAM FOLDED PRECURSOR RNA, of VGAM272 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM272 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 273 (VGAM273) viral gene, which modulates expression of respective host target genes thereof, the function and utility of which host target genes is known in the art.

VGAM273 is a novel bioinformatically detected regulatory, non protein coding, viral micro RNA (miRNA) gene. The method by which VGAM273 was detected is described hereinabove with reference to FIGS. 2-8.

VGAM273 gene, herein designated VGAM GENE, is a viral gene contained in the genome of Vaccinia virus. VGAM273 host target gene, herein designated VGAM HOST TARGET GENE, is a human gene contained in the human genome.

VGAM273 gene, herein designated VGAM GENE, encodes a VGAM273 precursor RNA, herein designated VGAM PRECURSOR RNA. Similar to other miRNA genes, and unlike most ordinary genes, VGAM273 precursor RNA, herein designated VGAM PRECURSOR RNA, does not encode a protein. A nucleotide sequence identical or highly similar to the nucleotide sequence of VGAM273 precursor RNA is designated SEQ ID:259, and is provided hereinbelow with reference to the sequence listing part. Nucleotide sequence SEQ ID:259 is located at position 154466 relative to the genome of Vaccinia virus.

VGAM273 precursor RNA, herein designated VGAM PRECURSOR RNA, folds onto itself, forming VGAM273 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM273 folded precursor RNA, herein designated VGAM FOLDED PRECURSOR RNA, into VGAM273 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 91%) nucleotide sequence of VGAM273 RNA is designated SEQ ID:608, and is provided hereinbelow with reference to the sequence listing part.

VGAM273 host target gene, herein designated VGAM HOST TARGET GENE, encodes a corresponding messenger RNA, VGAM273 host target RNA, herein designated VGAM HOST TARGET RNA. VGAM273 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM273 RNA, herein designated VGAM RNA, binds complementarily to one or more host target binding sites located in untranslated regions of VGAM273 host target RNA, herein designated VGAM HOST TARGET RNA. This complementary binding is due to the fact that the nucleotide sequence of VGAM273 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM273 RNA, herein designated VGAM RNA, may have a different number of host target binding sites in untranslated regions of a VGAM273 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM273 RNA, herein designated VGAM RNA, to host target binding sites on VGAM273 host target RNA, herein designated VGAM HOST TARGET RNA, such as BINDING SITE I, BINDING SITE II and BINDING SITE III, inhibits translation of VGAM273 host target RNA, herein designated VGAM HOST TARGET RNA, into VGAM273 host target protein, herein designated VGAM HOST TARGET PROTEIN. VGAM host target protein is therefore outlined by a broken line.

It is appreciated that VGAM273 host target gene, herein designated VGAM HOST TARGET GENE, in fact represents a plurality of VGAM273 host target genes. The mRNA of each one of this plurality of VGAM273 host target genes comprises one or more host target binding sites, each having a nucleotide sequence which is at least partly complementary to VGAM273 RNA, herein designated VGAM RNA, and which when bound by VGAM273 RNA, herein designated VGAM RNA, causes inhibition of translation of respective one or more VGAM273 host target proteins.

It is further appreciated by one skilled in the art that the mode of translational inhibition illustrated by FIG. 1 with specific reference to translational inhibition exerted by VGAM273 gene, herein designated VGAM GENE, on one or more VGAM273 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM273 is inhibition of expression of host target genes, as part of a novel viral mechanism of attacking a host. Accordingly, utilities of VGAM273 include diagnosis, prevention and treatment of viral infection by Vaccinia virus. Specific functions, and accordingly utilities, of VGAM273 correlate with, and may be deduced from, the identity of the host target genes which VGAM273 binds and inhibits, and the function of these host target genes, as elaborated hereinbelow.

Nucleotide sequences of the VGAM273 precursor RNA, herein designated VGAM PRECURSOR RNA, and of the diced VGAM273 RNA, herein designated VGAM RNA, and a schematic representation of the secondary folding of VGAM273 folded precursor RNA, herein designated VGAM FOLDED PRECURSOR RNA, of VGAM273 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM273 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 274 (VGAM274) viral gene, which modulates expression of respective host target genes thereof, the function and utility of which host target genes is known in the art.

VGAM274 is a novel bioinformatically detected regulatory, non protein coding, viral micro RNA (miRNA) gene. The method by which VGAM274 was detected is described hereinabove with reference to FIGS. 2-8.

VGAM274 gene, herein designated VGAM GENE, is a viral gene contained in the genome of Vaccinia virus. VGAM274 host target gene, herein designated VGAM HOST TARGET GENE, is a human gene contained in the human genome.

VGAM274 gene, herein designated VGAM GENE, encodes a VGAM274 precursor RNA, herein designated VGAM PRECURSOR RNA. Similar to other miRNA genes, and unlike most ordinary genes, VGAM274 precursor RNA, herein designated VGAM PRECURSOR RNA, does not encode a protein. A nucleotide sequence identical or highly similar to the nucleotide sequence of VGAM274 precursor RNA is designated SEQ ID:260, and is provided hereinbelow with reference to the sequence listing part. Nucleotide sequence SEQ ID:260 is located at position 156944 relative to the genome of Vaccinia virus.

VGAM274 precursor RNA, herein designated VGAM PRECURSOR RNA, folds onto itself, forming VGAM274 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM274 folded precursor RNA, herein designated VGAM FOLDED PRECURSOR RNA, into VGAM274 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 76%) nucleotide sequence of VGAM274 RNA is designated SEQ ID:609, and is provided hereinbelow with reference to the sequence listing part.

VGAM274 host target gene, herein designated VGAM HOST TARGET GENE, encodes a corresponding messenger RNA, VGAM274 host target RNA, herein designated VGAM HOST TARGET RNA. VGAM274 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM274 RNA, herein designated VGAM RNA, binds complementarily to one or more host target binding sites located in untranslated regions of VGAM274 host target RNA, herein designated VGAM HOST TARGET RNA. This complementary binding is due to the fact that the nucleotide sequence of VGAM274 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM274 RNA, herein designated VGAM RNA, may have a different number of host target binding sites in untranslated regions of a VGAM274 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM274 RNA, herein designated VGAM RNA, to host target binding sites on VGAM274 host target RNA, herein designated VGAM HOST TARGET RNA, such as BINDING SITE I, BINDING SITE II and BINDING SITE III, inhibits translation of VGAM274 host target RNA, herein designated VGAM HOST TARGET RNA, into VGAM274 host target protein, herein designated VGAM HOST TARGET PROTEIN. VGAM host target protein is therefore outlined by a broken line.

It is appreciated that VGAM274 host target gene, herein designated VGAM HOST TARGET GENE, in fact represents a plurality of VGAM274 host target genes. The mRNA of each one of this plurality of VGAM274 host target genes comprises one or more host target binding sites, each having a nucleotide sequence which is at least partly complementary to VGAM274 RNA, herein designated VGAM RNA, and which when bound by VGAM274 RNA, herein designated VGAM RNA, causes inhibition of translation of respective one or more VGAM274 host target proteins.

It is further appreciated by one skilled in the art that the mode of translational inhibition illustrated by FIG. 1 with specific reference to translational inhibition exerted by VGAM274 gene, herein designated VGAM GENE, on one or more VGAM274 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM274 is inhibition of expression of host target genes, as part of a novel viral mechanism of attacking a host. Accordingly, utilities of VGAM274 include diagnosis, prevention and treatment of viral infection by Vaccinia virus. Specific functions, and accordingly utilities, of VGAM274 correlate with, and may be deduced from, the identity of the host target genes which VGAM274 binds and inhibits, and the function of these host target genes, as elaborated hereinbelow.

Nucleotide sequences of the VGAM274 precursor RNA, herein designated VGAM PRECURSOR RNA, and of the diced VGAM274 RNA, herein designated VGAM RNA, and a schematic representation of the secondary folding of VGAM274 folded precursor RNA, herein designated VGAM FOLDED PRECURSOR RNA, of VGAM274 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM274 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 275 (VGAM275) viral gene, which modulates expression of respective host target genes thereof, the function and utility of which host target genes is known in the art.

VGAM275 is a novel bioinformatically detected regulatory, non protein coding, viral micro RNA (miRNA) gene. The method by which VGAM275 was detected is described hereinabove with reference to FIGS. 2-8.

VGAM275 gene, herein designated VGAM GENE, is a viral gene contained in the genome of Vaccinia virus. VGAM275 host target gene, herein designated VGAM HOST TARGET GENE, is a human gene contained in the human genome.

VGAM275 gene, herein designated VGAM GENE, encodes a VGAM275 precursor RNA, herein designated VGAM PRECURSOR RNA. Similar to other miRNA genes, and unlike most ordinary genes, VGAM275 precursor RNA, herein designated VGAM PRECURSOR RNA, does not encode a protein. A nucleotide sequence identical or highly similar to the nucleotide sequence of VGAM275 precursor RNA is designated SEQ ID:261, and is provided hereinbelow with reference to the sequence listing part. Nucleotide sequence SEQ ID:261 is located at position 157919 relative to the genome of Vaccinia virus.

VGAM275 precursor RNA, herein designated VGAM PRECURSOR RNA, folds onto itself, forming VGAM275 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM275 folded precursor RNA, herein designated VGAM FOLDED PRECURSOR RNA, into VGAM275 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM275 RNA is designated SEQ ID:610, and is provided hereinbelow with reference to the sequence listing part.

VGAM275 host target gene, herein designated VGAM HOST TARGET GENE, encodes a corresponding messenger RNA, VGAM275 host target RNA, herein designated VGAM HOST TARGET RNA. VGAM275 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM275 RNA, herein designated VGAM RNA, binds complementarily to one or more host target binding sites located in untranslated regions of VGAM275 host target RNA, herein designated VGAM HOST TARGET RNA. This complementary binding is due to the fact that the nucleotide sequence of VGAM275 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM275 RNA, herein designated VGAM RNA, may have a different number of host target binding sites in untranslated regions of a VGAM275 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM275 RNA, herein designated VGAM RNA, to host target binding sites on VGAM275 host target RNA, herein designated VGAM HOST TARGET RNA, such as BINDING SITE I, BINDING SITE II and BINDING SITE III, inhibits translation of VGAM275 host target RNA, herein designated VGAM HOST TARGET RNA, into VGAM275 host target protein, herein designated VGAM HOST TARGET PROTEIN. VGAM host target protein is therefore outlined by a broken line.

It is appreciated that VGAM275 host target gene, herein designated VGAM HOST TARGET GENE, in fact represents a plurality of VGAM275 host target genes. The mRNA of each one of this plurality of VGAM275 host target genes comprises one or more host target binding sites, each having a nucleotide sequence which is at least partly complementary to VGAM275 RNA, herein designated VGAM RNA, and which when bound by VGAM275 RNA, herein designated VGAM RNA, causes inhibition of translation of respective one or more VGAM275 host target proteins.

It is further appreciated by one skilled in the art that the mode of translational inhibition illustrated by FIG. 1 with specific reference to translational inhibition exerted by VGAM275 gene, herein designated VGAM GENE, on one or more VGAM275 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM275 is inhibition of expression of host target genes, as part of a novel viral mechanism of attacking a host. Accordingly, utilities of VGAM275 include diagnosis, prevention and treatment of viral infection by Vaccinia virus. Specific functions, and accordingly utilities, of VGAM275 correlate with, and may be deduced from, the identity of the host target genes which VGAM275 binds and inhibits, and the function of these host target genes, as elaborated hereinbelow.

Nucleotide sequences of the VGAM275 precursor RNA, herein designated VGAM PRECURSOR RNA, and of the diced VGAM275 RNA, herein designated VGAM RNA, and a schematic representation of the secondary folding of VGAM275 folded precursor RNA, herein designated VGAM FOLDED PRECURSOR RNA, of VGAM275 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM275 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 276 (VGAM276) viral gene, which modulates expression of respective host target genes thereof, the function and utility of which host target genes is known in the art.

VGAM276 is a novel bioinformatically detected regulatory, non protein coding, viral micro RNA (miRNA) gene. The method by which VGAM276 was detected is described hereinabove with reference to FIGS. 2-8.

VGAM276 gene, herein designated VGAM GENE, is a viral gene contained in the genome of Vaccinia virus. VGAM276 host target gene, herein designated VGAM HOST TARGET GENE, is a human gene contained in the human genome.

VGAM276 gene, herein designated VGAM GENE, encodes a VGAM276 precursor RNA, herein designated VGAM PRECURSOR RNA. Similar to other miRNA genes, and unlike most ordinary genes, VGAM276 precursor RNA, herein designated VGAM PRECURSOR RNA, does not encode a protein. A nucleotide sequence identical or highly similar to the nucleotide sequence of VGAM276 precursor RNA is designated SEQ ID:262, and is provided hereinbelow with reference to the sequence listing part. Nucleotide sequence SEQ ID:262 is located at position 156818 relative to the genome of Vaccinia virus.

VGAM276 precursor RNA, herein designated VGAM PRECURSOR RNA, folds onto itself, forming VGAM276 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM276 folded precursor RNA, herein designated VGAM FOLDED PRECURSOR RNA, into VGAM276 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 78%) nucleotide sequence of VGAM276 RNA is designated SEQ ID:611, and is provided hereinbelow with reference to the sequence listing part.

VGAM276 host target gene, herein designated VGAM HOST TARGET GENE, encodes a corresponding messenger RNA, VGAM276 host target RNA, herein designated VGAM HOST TARGET RNA. VGAM276 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM276 RNA, herein designated VGAM RNA, binds complementarily to one or more host target binding sites located in untranslated regions of VGAM276 host target RNA, herein designated VGAM HOST TARGET RNA. This complementary binding is due to the fact that the nucleotide sequence of VGAM276 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM276 RNA, herein designated VGAM RNA, may have a different number of host target binding sites in untranslated regions of a VGAM276 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM276 RNA, herein designated VGAM RNA, to host target binding sites on VGAM276 host target RNA, herein designated VGAM HOST TARGET RNA, such as BINDING SITE I, BINDING SITE II and BINDING SITE III, inhibits translation of VGAM276 host target RNA, herein designated VGAM HOST TARGET RNA, into VGAM276 host target protein, herein designated VGAM HOST TARGET PROTEIN. VGAM host target protein is therefore outlined by a broken line.

It is appreciated that VGAM276 host target gene, herein designated VGAM HOST TARGET GENE, in fact represents a plurality of VGAM276 host target genes. The mRNA of each one of this plurality of VGAM276 host target genes comprises one or more host target binding sites, each having a nucleotide sequence which is at least partly complementary to VGAM276 RNA, herein designated VGAM RNA, and which when bound by VGAM276 RNA, herein designated VGAM RNA, causes inhibition of translation of respective one or more VGAM276 host target proteins.

It is further appreciated by one skilled in the art that the mode of translational inhibition illustrated by FIG. 1 with specific reference to translational inhibition exerted by VGAM276 gene, herein designated VGAM GENE, on one or more VGAM276 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM276 is inhibition of expression of host target genes, as part of a novel viral mechanism of attacking a host. Accordingly, utilities of VGAM276 include diagnosis, prevention and treatment of viral infection by Vaccinia virus. Specific functions, and accordingly utilities, of VGAM276 correlate with, and may be deduced from, the identity of the host target genes which VGAM276 binds and inhibits, and the function of these host target genes, as elaborated hereinbelow.

Nucleotide sequences of the VGAM276 precursor RNA, herein designated VGAM PRECURSOR RNA, and of the diced VGAM276 RNA, herein designated VGAM RNA, and a schematic representation of the secondary folding of VGAM276 folded precursor RNA, herein designated VGAM FOLDED PRECURSOR RNA, of VGAM276 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM276 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 277 (VGAM277) viral gene, which modulates expression of respective host target genes thereof, the function and utility of which host target genes is known in the art.

VGAM277 is a novel bioinformatically detected regulatory, non protein coding, viral micro RNA (miRNA) gene. The method by which VGAM277 was detected is described hereinabove with reference to FIGS. 2-8.

VGAM277 gene, herein designated VGAM GENE, is a viral gene contained in the genome of Vaccinia virus. VGAM277 host target gene, herein designated VGAM HOST TARGET GENE, is a human gene contained in the human genome.

VGAM277 gene, herein designated VGAM GENE, encodes a VGAM277 precursor RNA, herein designated VGAM PRECURSOR RNA. Similar to other miRNA genes, and unlike most ordinary genes, VGAM277 precursor RNA, herein designated VGAM PRECURSOR RNA, does not encode a protein. A nucleotide sequence identical or highly similar to the nucleotide sequence of VGAM277 precursor RNA is designated SEQ ID:263, and is provided hereinbelow with reference to the sequence listing part. Nucleotide sequence SEQ ID:263 is located at position 157748 relative to the genome of Vaccinia virus.

VGAM277 precursor RNA, herein designated VGAM PRECURSOR RNA, folds onto itself, forming VGAM277 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM277 folded precursor RNA, herein designated VGAM FOLDED PRECURSOR RNA, into VGAM277 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 72%) nucleotide sequence of VGAM277 RNA is designated SEQ ID:612, and is provided hereinbelow with reference to the sequence listing part.

VGAM277 host target gene, herein designated VGAM HOST TARGET GENE, encodes a corresponding messenger RNA, VGAM277 host target RNA, herein designated VGAM HOST TARGET RNA. VGAM277 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM277 RNA, herein designated VGAM RNA, binds complementarily to one or more host target binding sites located in untranslated regions of VGAM277 host target RNA, herein designated VGAM HOST TARGET RNA. This complementary binding is due to the fact that the nucleotide sequence of VGAM277 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting. VGAM277 RNA, herein designated VGAM RNA, may have a different number of host target binding sites in untranslated regions of a VGAM277 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM277 RNA, herein designated VGAM RNA, to host target binding sites on VGAM277 host target RNA, herein designated VGAM HOST TARGET RNA, such as BINDING SITE I, BINDING SITE II and BINDING SITE III, inhibits translation of VGAM277 host target RNA, herein designated VGAM HOST TARGET RNA, into VGAM277 host target protein, herein designated VGAM HOST TARGET PROTEIN. VGAM host target protein is therefore outlined by a broken line.

It is appreciated that VGAM277 host target gene, herein designated VGAM HOST TARGET GENE, in fact represents a plurality of VGAM277 host target genes. The mRNA of each one of this plurality of VGAM277 host target genes comprises one or more host target binding sites, each having a nucleotide sequence which is at least partly complementary to VGAM277 RNA, herein designated VGAM RNA, and which when bound by VGAM277 RNA, herein designated VGAM RNA, causes inhibition of translation of respective one or more VGAM277 host target proteins.

It is further appreciated by one skilled in the art that the mode of translational inhibition illustrated by FIG. 1 with specific reference to translational inhibition exerted by VGAM277 gene, herein designated VGAM GENE, on one or more VGAM277 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM277 is inhibition of expression of host target genes, as part of a novel viral mechanism of attacking a host. Accordingly, utilities of VGAM277 include diagnosis, prevention and treatment of viral infection by Vaccinia virus. Specific functions, and accordingly utilities, of VGAM277 correlate with, and may be deduced from, the identity of the host target genes which VGAM277 binds and inhibits, and the function of these host target genes, as elaborated hereinbelow.

Nucleotide sequences of the VGAM277 precursor RNA, herein designated VGAM PRECURSOR RNA, and of the diced VGAM277 RNA, herein designated VGAM RNA, and a schematic representation of the secondary folding of VGAM277 folded precursor RNA, herein designated VGAM FOLDED PRECURSOR RNA, of VGAM277 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM277 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 278 (VGAM278) viral gene, which modulates expression of respective host target genes thereof, the function and utility of which host target genes is known in the art.

VGAM278 is a novel bioinformatically detected regulatory, non protein coding, viral micro RNA (miRNA) gene. The method by which VGAM278 was detected is described hereinabove with reference to FIGS. 2-8.

VGAM278 gene, herein designated VGAM GENE, is a viral gene contained in the genome of Vaccinia virus. VGAM278 host target gene, herein designated VGAM HOST TARGET GENE, is a human gene contained in the human genome.

VGAM278 gene, herein designated VGAM GENE, encodes a VGAM278 precursor RNA, herein designated VGAM PRECURSOR RNA. Similar to other miRNA genes, and unlike most ordinary genes, VGAM278 precursor RNA, herein designated VGAM PRECURSOR RNA, does not encode a protein. A nucleotide sequence identical or highly similar to the nucleotide sequence of VGAM278 precursor RNA is designated SEQ ID:264, and is provided hereinbelow with reference to the sequence listing part. Nucleotide sequence SEQ ID:264 is located at position 158423 relative to the genome of Vaccinia virus.

VGAM278 precursor RNA, herein designated VGAM PRECURSOR RNA, folds onto itself, forming VGAM278 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM278 folded precursor RNA, herein designated VGAM FOLDED PRECURSOR RNA, into VGAM278 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 94%) nucleotide sequence of VGAM278 RNA is designated SEQ ID:613, and is provided hereinbelow with reference to the sequence listing part.

VGAM278 host target gene, herein designated VGAM HOST TARGET GENE, encodes a corresponding messenger RNA, VGAM278 host target RNA, herein designated VGAM HOST TARGET RNA. VGAM278 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM278 RNA, herein designated VGAM RNA, binds complementarily to one or more host target binding sites located in untranslated regions of VGAM278 host target RNA, herein designated VGAM HOST TARGET RNA. This complementary binding is due to the fact that the nucleotide sequence of VGAM278 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting. VGAM278 RNA, herein designated VGAM RNA, may have a different number of host target binding sites in untranslated regions of a VGAM278 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM278 RNA, herein designated VGAM RNA, to host target binding sites on VGAM278 host target RNA, herein designated VGAM HOST TARGET RNA, such as BINDING SITE I, BINDING SITE II and BINDING SITE III, inhibits translation of VGAM278 host target RNA, herein designated VGAM HOST TARGET RNA, into VGAM278 host target protein, herein designated VGAM HOST TARGET PROTEIN. VGAM host target protein is therefore outlined by a broken line.

It is appreciated that VGAM278 host target gene, herein designated VGAM HOST TARGET GENE, in fact represents a plurality of VGAM278 host target genes. The mRNA of each one of this plurality of VGAM278 host target genes comprises one or more host target binding sites, each having a nucleotide sequence which is at least partly complementary to VGAM278 RNA, herein designated VGAM RNA, and which when bound by VGAM278 RNA, herein designated VGAM RNA, causes inhibition of translation of respective one or more VGAM278 host target proteins.

It is further appreciated by one skilled in the art that the mode of translational inhibition illustrated by FIG. 1 with specific reference to translational inhibition exerted by VGAM278 gene, herein designated VGAM GENE, on one or more VGAM278 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM278 is inhibition of expression of host target genes, as part of a novel viral mechanism of attacking a host. Accordingly, utilities of VGAM278 include diagnosis, prevention and treatment of viral infection by Vaccinia virus. Specific functions, and accordingly utilities, of VGAM278 correlate with, and may be deduced from, the identity of the host target genes which VGAM278 binds and inhibits, and the function of these host target genes, as elaborated hereinbelow.

Nucleotide sequences of the VGAM278 precursor RNA, herein designated VGAM PRECURSOR RNA, and of the diced VGAM278 RNA, herein designated VGAM RNA, and a schematic representation of the secondary folding of VGAM278 folded precursor RNA, herein designated VGAM FOLDED PRECURSOR RNA, of VGAM278 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM278 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 279 (VGAM279) viral gene, which modulates expression of respective host target genes thereof, the function and utility of which host target genes is known in the art.

VGAM279 is a novel bioinformatically detected regulatory, non protein coding, viral micro RNA (miRNA) gene. The method by which VGAM279 was detected is described hereinabove with reference to FIGS. 2-8.

VGAM279 gene, herein designated VGAM GENE, is a viral gene contained in the genome of Vaccinia virus. VGAM279 host target gene, herein designated VGAM HOST TARGET GENE, is a human gene contained in the human genome.

VGAM279 gene, herein designated VGAM GENE, encodes a VGAM279 precursor RNA, herein designated VGAM PRECURSOR RNA. Similar to other miRNA genes, and unlike most ordinary genes, VGAM279 precursor RNA, herein designated VGAM PRECURSOR RNA, does not encode a protein. A nucleotide sequence identical or highly similar to the nucleotide sequence of VGAM279 precursor RNA is designated SEQ ID:265, and is provided hereinbelow with reference to the sequence listing part. Nucleotide sequence SEQ ID:265 is located at position 161106 relative to the genome of Vaccinia virus.

VGAM279 precursor RNA, herein designated VGAM PRECURSOR RNA, folds onto itself, forming VGAM279 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM279 folded precursor RNA, herein designated VGAM FOLDED PRECURSOR RNA, into VGAM279 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM279 RNA is designated SEQ ID:614, and is provided hereinbelow with reference to the sequence listing part.

VGAM279 host target gene, herein designated VGAM HOST TARGET GENE, encodes a corresponding messenger RNA, VGAM279 host target RNA, herein designated VGAM HOST TARGET RNA. VGAM279 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM279 RNA, herein designated VGAM RNA, binds complementarily to one or more host target binding sites located in untranslated regions of VGAM279 host target RNA, herein designated VGAM HOST TARGET RNA. This complementary binding is due to the fact that the nucleotide sequence of VGAM279 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM279 RNA, herein designated VGAM RNA, may have a different number of host target binding sites in untranslated regions of a VGAM279 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM279 RNA, herein designated VGAM RNA, to host target binding sites on VGAM279 host target RNA, herein designated VGAM HOST TARGET RNA, such as BINDING SITE I, BINDING SITE II and BINDING SITE III, inhibits translation of VGAM279 host target RNA, herein designated VGAM HOST TARGET RNA, into VGAM279 host target protein, herein designated VGAM HOST TARGET PROTEIN. VGAM host target protein is therefore outlined by a broken line.

It is appreciated that VGAM279 host target gene, herein designated VGAM HOST TARGET GENE, in fact represents a plurality of VGAM279 host target genes. The mRNA of each one of this plurality of VGAM279 host target genes comprises one or more host target binding sites, each having a nucleotide sequence which is at least partly complementary to VGAM279 RNA, herein designated VGAM RNA, and which when bound by VGAM279 RNA, herein designated VGAM RNA, causes inhibition of translation of respective one or more VGAM279 host target proteins.

It is further appreciated by one skilled in the art that the mode of translational inhibition illustrated by FIG. 1 with specific reference to translational inhibition exerted by VGAM279 gene, herein designated VGAM GENE, on one or more VGAM279 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM279 is inhibition of expression of host target genes, as part of a novel viral mechanism of attacking a host. Accordingly, utilities of VGAM279 include diagnosis, prevention and treatment of viral infection by Vaccinia virus. Specific functions, and accordingly utilities, of VGAM279 correlate with, and may be deduced from, the identity of the host target genes which VGAM279 binds and inhibits, and the function of these host target genes, as elaborated hereinbelow.

Nucleotide sequences of the VGAM279 precursor RNA, herein designated VGAM PRECURSOR RNA, and of the diced VGAM279 RNA, herein designated VGAM RNA, and a schematic representation of the secondary folding of VGAM279 folded precursor RNA, herein designated VGAM FOLDED PRECURSOR RNA, of VGAM279 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM279 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 280 (VGAM280) viral gene, which modulates expression of respective host target genes thereof, the function and utility of which host target genes is known in the art.

VGAM280 is a novel bioinformatically detected regulatory, non protein coding, viral micro RNA (miRNA) gene. The method by which VGAM280 was detected is described hereinabove with reference to FIGS. 2-8.

VGAM280 gene, herein designated VGAM GENE, is a viral gene contained in the genome of Vaccinia virus. VGAM280 host target gene, herein designated VGAM HOST TARGET GENE, is a human gene contained in the human genome.

VGAM280 gene, herein designated VGAM GENE, encodes a VGAM280 precursor RNA, herein designated VGAM PRECURSOR RNA. Similar to other miRNA genes, and unlike most ordinary genes, VGAM280 precursor RNA, herein designated VGAM PRECURSOR RNA, does not encode a protein. A nucleotide sequence identical or highly similar to the nucleotide sequence of VGAM280 precursor RNA is designated SEQ ID:266, and is provided hereinbelow with reference to the sequence listing part. Nucleotide sequence SEQ ID:266 is located at position 159680 relative to the genome of Vaccinia virus.

VGAM280 precursor RNA, herein designated VGAM PRECURSOR RNA, folds onto itself, forming VGAM280 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM280 folded precursor RNA, herein designated VGAM FOLDED PRECURSOR RNA, into VGAM280 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM280 RNA is designated SEQ ID:615, and is provided hereinbelow with reference to the sequence listing part.

VGAM280 host target gene, herein designated VGAM HOST TARGET GENE, encodes a corresponding messenger RNA, VGAM280 host target RNA, herein designated VGAM HOST TARGET RNA. VGAM280 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM280 RNA, herein designated VGAM RNA, binds complementarily to one or more host target binding sites located in untranslated regions of VGAM280 host target RNA, herein designated VGAM HOST TARGET RNA. This complementary binding is due to the fact that the nucleotide sequence of VGAM280 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM280 RNA, herein designated VGAM RNA, may have a different number of host target binding sites in untranslated regions of a VGAM280 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM280 RNA, herein designated VGAM RNA, to host target binding sites on VGAM280 host target RNA, herein designated VGAM HOST TARGET RNA, such as BINDING SITE I, BINDING SITE II and BINDING SITE III, inhibits translation of VGAM280 host target RNA, herein designated VGAM HOST TARGET RNA, into VGAM280 host target protein, herein designated VGAM HOST TARGET PROTEIN. VGAM host target protein is therefore outlined by a broken line.

It is appreciated that VGAM280 host target gene, herein designated VGAM HOST TARGET GENE, in fact represents a plurality of VGAM280 host target genes. The mRNA of each one of this plurality of VGAM280 host target genes comprises one or more host target binding sites, each having a nucleotide sequence which is at least partly complementary to VGAM280 RNA, herein designated VGAM RNA, and which when bound by VGAM280 RNA, herein designated VGAM RNA, causes inhibition of translation of respective one or more VGAM280 host target proteins.

It is further appreciated by one skilled in the art that the mode of translational inhibition illustrated by FIG. 1 with specific reference to translational inhibition exerted by VGAM280 gene, herein designated VGAM GENE, on one or more VGAM280 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM280 is inhibition of expression of host target genes, as part of a novel viral mechanism of attacking a host. Accordingly, utilities of VGAM280 include diagnosis, prevention and treatment of viral infection by Vaccinia virus. Specific functions, and accordingly utilities, of VGAM280 correlate with, and may be deduced from, the identity of the host target genes which VGAM280 binds and inhibits, and the function of these host target genes, as elaborated hereinbelow.

Nucleotide sequences of the VGAM280 precursor RNA, herein designated VGAM PRECURSOR RNA, and of the diced VGAM280 RNA, herein designated VGAM RNA, and a schematic representation of the secondary folding of VGAM280 folded precursor RNA, herein designated VGAM FOLDED PRECURSOR RNA, of VGAM280 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM280 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 281 (VGAM281) viral gene, which modulates expression of respective host target genes thereof, the function and utility of which host target genes is known in the art.

VGAM281 is a novel bioinformatically detected regulatory, non protein coding, viral micro RNA (miRNA) gene. The method by which VGAM281 was detected is described hereinabove with reference to FIGS. 2-8.

VGAM281 gene, herein designated VGAM GENE, is a viral gene contained in the genome of Vaccinia virus. VGAM281 host target gene, herein designated VGAM HOST TARGET GENE, is a human gene contained in the human genome.

VGAM281 gene, herein designated VGAM GENE, encodes a VGAM281 precursor RNA, herein designated VGAM PRECURSOR RNA. Similar to other miRNA genes, and unlike most ordinary genes, VGAM281 precursor RNA, herein designated VGAM PRECURSOR RNA, does not encode a protein. A nucleotide sequence identical or highly similar to the nucleotide sequence of VGAM281 precursor RNA is designated SEQ ID:267, and is provided hereinbelow with reference to the sequence listing part. Nucleotide sequence SEQ ID:267 is located at position 160226 relative to the genome of Vaccinia virus.

VGAM281 precursor RNA, herein designated VGAM PRECURSOR RNA, folds onto itself, forming VGAM281 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM281 folded precursor RNA, herein designated VGAM FOLDED PRECURSOR RNA, into VGAM281 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM281 RNA is designated SEQ ID:616, and is provided hereinbelow with reference to the sequence listing part.

VGAM281 host target gene, herein designated VGAM HOST TARGET GENE, encodes a corresponding messenger RNA, VGAM281 host target RNA, herein designated VGAM HOST TARGET RNA. VGAM281 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM281 RNA, herein designated VGAM RNA, binds complementarily to one or more host target binding sites located in untranslated regions of VGAM281 host target RNA, herein designated VGAM HOST TARGET RNA. This complementary binding is due to the fact that the nucleotide sequence of VGAM281 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM281 RNA, herein designated VGAM RNA, may have a different number of host target binding sites in untranslated regions of a VGAM281 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM281 RNA, herein designated VGAM RNA, to host target binding sites on VGAM281 host target RNA, herein designated VGAM HOST TARGET RNA, such as BINDING SITE I, BINDING SITE II and BINDING SITE III, inhibits translation of VGAM281 host target RNA, herein designated VGAM HOST TARGET RNA, into VGAM281 host target protein, herein designated VGAM HOST TARGET PROTEIN. VGAM host target protein is therefore outlined by a broken line.

It is appreciated that VGAM281 host target gene, herein designated VGAM HOST TARGET GENE, in fact represents a plurality of VGAM281 host target genes. The mRNA of each one of this plurality of VGAM281 host target genes comprises one or more host target binding sites, each having a nucleotide sequence which is at least partly complementary to VGAM281 RNA, herein designated VGAM RNA, and which when bound by VGAM281 RNA, herein designated VGAM RNA, causes inhibition of translation of respective one or more VGAM281 host target proteins.

It is further appreciated by one skilled in the art that the mode of translational inhibition illustrated by FIG. 1 with specific reference to translational inhibition exerted by VGAM281 gene, herein designated VGAM GENE, on one or more VGAM281 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM281 is inhibition of expression of host target genes, as part of a novel viral mechanism of attacking a host. Accordingly, utilities of VGAM281 include diagnosis, prevention and treatment of viral infection by Vaccinia virus. Specific functions, and accordingly utilities, of VGAM281 correlate with, and may be deduced from, the identity of the host target genes which VGAM281 binds and inhibits, and the function of these host target genes, as elaborated hereinbelow.

Nucleotide sequences of the VGAM281 precursor RNA, herein designated VGAM PRECURSOR RNA, and of the diced VGAM281 RNA, herein designated VGAM RNA, and a schematic representation of the secondary folding of VGAM281 folded precursor RNA, herein designated VGAM FOLDED PRECURSOR RNA, of VGAM281 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM281 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 282 (VGAM282) viral gene, which modulates expression of respective host target genes thereof, the function and utility of which host target genes is known in the art.

VGAM282 is a novel bioinformatically detected regulatory, non protein coding, viral micro RNA (miRNA) gene. The method by which VGAM282 was detected is described hereinabove with reference to FIGS. 2-8.

VGAM282 gene, herein designated VGAM GENE, is a viral gene contained in the genome of Vaccinia virus. VGAM282 host target gene, herein designated VGAM HOST TARGET GENE, is a human gene contained in the human genome.

VGAM282 gene, herein designated VGAM GENE, encodes a VGAM282 precursor RNA, herein designated VGAM PRECURSOR RNA. Similar to other miRNA genes, and unlike most ordinary genes, VGAM282 precursor RNA, herein designated VGAM PRECURSOR RNA, does not encode a protein. A nucleotide sequence identical or highly similar to the nucleotide sequence of VGAM282 precursor RNA is designated SEQ ID:268, and is provided hereinbelow with reference to the sequence listing part. Nucleotide sequence SEQ ID:268 is located at position 161325 relative to the genome of Vaccinia virus.

VGAM282 precursor RNA, herein designated VGAM PRECURSOR RNA, folds onto itself, forming VGAM282 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM282 folded precursor RNA, herein designated VGAM FOLDED PRECURSOR RNA, into VGAM282 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM282 RNA is designated SEQ ID:617, and is provided hereinbelow with reference to the sequence listing part.

VGAM282 host target gene, herein designated VGAM HOST TARGET GENE, encodes a corresponding messenger RNA, VGAM282 host target RNA, herein designated VGAM HOST TARGET RNA. VGAM282 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM282 RNA, herein designated VGAM RNA, binds complementarily to one or more host target binding sites located in untranslated regions of VGAM282 host target RNA, herein designated VGAM HOST TARGET RNA. This complementary binding is due to the fact that the nucleotide sequence of VGAM282 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM282 RNA, herein designated VGAM RNA, may have a different number of host target binding sites in untranslated regions of a VGAM282 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM282 RNA, herein designated VGAM RNA, to host target binding sites on VGAM282 host target RNA, herein designated VGAM HOST TARGET RNA, such as BINDING SITE I, BINDING SITE II and BINDING SITE III, inhibits translation of VGAM282 host target RNA, herein designated VGAM HOST TARGET RNA, into VGAM282 host target protein, herein designated VGAM HOST TARGET PROTEIN. VGAM host target protein is therefore outlined by a broken line.

It is appreciated that VGAM282 host target gene, herein designated VGAM HOST TARGET GENE, in fact represents a plurality of VGAM282 host target genes. The mRNA of each one of this plurality of VGAM282 host target genes comprises one or more host target binding sites, each having a nucleotide sequence which is at least partly complementary to VGAM282 RNA, herein designated VGAM RNA, and which when bound by VGAM282 RNA, herein designated VGAM RNA, causes inhibition of translation of respective one or more VGAM282 host target proteins.

It is further appreciated by one skilled in the art that the mode of translational inhibition illustrated by FIG. 1 with specific reference to translational inhibition exerted by VGAM282 gene, herein designated VGAM GENE, on one or more VGAM282 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM282 is inhibition of expression of host target genes, as part of a novel viral mechanism of attacking a host. Accordingly, utilities of VGAM282 include diagnosis, prevention and treatment of viral infection by Vaccinia virus. Specific functions, and accordingly utilities, of VGAM282 correlate with, and may be deduced from, the identity of the host target genes which VGAM282 binds and inhibits, and the function of these host target genes, as elaborated hereinbelow.

Nucleotide sequences of the VGAM282 precursor RNA, herein designated VGAM PRECURSOR RNA, and of the diced VGAM282 RNA, herein designated VGAM RNA, and a schematic representation of the secondary folding of VGAM282 folded precursor RNA, herein designated VGAM FOLDED PRECURSOR RNA, of VGAM282 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM282 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 283 (VGAM283) viral gene, which modulates expression of respective host target genes thereof, the function and utility of which host target genes is known in the art.

VGAM283 is a novel bioinformatically detected regulatory, non protein coding, viral micro RNA (miRNA) gene. The method by which VGAM283 was detected is described hereinabove with reference to FIGS. 2-8.

VGAM283 gene, herein designated VGAM GENE, is a viral gene contained in the genome of Vaccinia virus. VGAM283 host target gene, herein designated VGAM HOST TARGET GENE, is a human gene contained in the human genome.

VGAM283 gene, herein designated VGAM GENE, encodes a VGAM283 precursor RNA, herein designated VGAM PRECURSOR RNA. Similar to other miRNA genes, and unlike most ordinary genes, VGAM283 precursor RNA, herein designated VGAM PRECURSOR RNA, does not encode a protein. A nucleotide sequence identical or highly similar to the nucleotide sequence of VGAM283 precursor RNA is designated SEQ ID:269, and is provided hereinbelow with reference to the sequence listing part. Nucleotide sequence SEQ ID:269 is located at position 158874 relative to the genome of Vaccinia virus.

VGAM283 precursor RNA, herein designated VGAM PRECURSOR RNA, folds onto itself, forming VGAM283 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM283 folded precursor RNA, herein designated VGAM FOLDED PRECURSOR RNA, into VGAM283 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 87%) nucleotide sequence of VGAM283 RNA is designated SEQ ID:618, and is provided hereinbelow with reference to the sequence listing part.

VGAM283 host target gene, herein designated VGAM HOST TARGET GENE, encodes a corresponding messenger RNA, VGAM283 host target RNA, herein designated VGAM HOST TARGET RNA. VGAM283 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM283 RNA, herein designated VGAM RNA, binds complementarily to one or more host target binding sites located in untranslated regions of VGAM283 host target RNA, herein designated VGAM HOST TARGET RNA. This complementary binding is due to the fact that the nucleotide sequence of VGAM283 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM283 RNA, herein designated VGAM RNA, may have a different number of host target binding sites in untranslated regions of a VGAM283 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM283 RNA, herein designated VGAM RNA, to host target binding sites on VGAM283 host target RNA, herein designated VGAM HOST TARGET RNA, such as BINDING SITE I, BINDING SITE II and BINDING SITE III, inhibits translation of VGAM283 host target RNA, herein designated VGAM HOST TARGET RNA, into VGAM283 host target protein, herein designated VGAM HOST TARGET PROTEIN. VGAM host target protein is therefore outlined by a broken line.

It is appreciated that VGAM283 host target gene, herein designated VGAM HOST TARGET GENE, in fact represents a plurality of VGAM283 host target genes. The mRNA of each one of this plurality of VGAM283 host target genes comprises one or more host target binding sites, each having a nucleotide sequence which is at least partly complementary to VGAM283 RNA, herein designated VGAM RNA, and which when bound by VGAM283 RNA, herein designated VGAM RNA, causes inhibition of translation of respective one or more VGAM283 host target proteins.

It is further appreciated by one skilled in the art that the mode of translational inhibition illustrated by FIG. 1 with specific reference to translational inhibition exerted by VGAM283 gene, herein designated VGAM GENE, on one or more VGAM283 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM283 is inhibition of expression of host target genes, as part of a novel viral mechanism of attacking a host. Accordingly, utilities of VGAM283 include diagnosis, prevention and treatment of viral infection by Vaccinia virus. Specific functions, and accordingly utilities, of VGAM283 correlate with, and may be deduced from, the identity of the host target genes which VGAM283 binds and inhibits, and the function of these host target genes, as elaborated hereinbelow.

Nucleotide sequences of the VGAM283 precursor RNA, herein designated VGAM PRECURSOR RNA, and of the diced VGAM283 RNA, herein designated VGAM RNA, and a schematic representation of the secondary folding of VGAM283 folded precursor RNA, herein designated VGAM FOLDED PRECURSOR RNA, of VGAM283 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM283 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 284 (VGAM284) viral gene, which modulates expression of respective host target genes thereof, the function and utility of which host target genes is known in the art.

VGAM284 is a novel bioinformatically detected regulatory, non protein coding, viral micro RNA (miRNA) gene. The method by which VGAM284 was detected is described hereinabove with reference to FIGS. 2-8.

VGAM284 gene, herein designated VGAM GENE, is a viral gene contained in the genome of Vaccinia virus. VGAM284 host target gene, herein designated VGAM HOST TARGET GENE, is a human gene contained in the human genome.

VGAM284 gene, herein designated VGAM GENE, encodes a VGAM284 precursor RNA, herein designated VGAM PRECURSOR RNA. Similar to other miRNA genes, and unlike most ordinary genes, VGAM284 precursor RNA, herein designated VGAM PRECURSOR RNA, does not encode a protein. A nucleotide sequence identical or highly similar to the nucleotide sequence of VGAM284 precursor RNA is designated SEQ ID:270, and is provided hereinbelow with reference to the sequence listing part. Nucleotide sequence SEQ ID:270 is located at position 159230 relative to the genome of Vaccinia virus.

VGAM284 precursor RNA, herein designated VGAM PRECURSOR RNA, folds onto itself, forming VGAM284 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM284 folded precursor RNA, herein designated VGAM FOLDED PRECURSOR RNA, into VGAM284 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM284 RNA is designated SEQ ID:619, and is provided hereinbelow with reference to the sequence listing part.

VGAM284 host target gene, herein designated VGAM HOST TARGET GENE, encodes a corresponding messenger RNA, VGAM284 host target RNA, herein designated VGAM HOST TARGET RNA. VGAM284 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM284 RNA, herein designated VGAM RNA, binds complementarily to one or more host target binding sites located in untranslated regions of VGAM284 host target RNA, herein designated VGAM HOST TARGET RNA. This complementary binding is due to the fact that the nucleotide sequence of VGAM284 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM284 RNA, herein designated VGAM RNA, may have a different number of host target binding sites in untranslated regions of a VGAM284 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM284 RNA, herein designated VGAM RNA, to host target binding sites on VGAM284 host target RNA, herein designated VGAM HOST TARGET RNA, such as BINDING SITE I, BINDING SITE II and BINDING SITE III, inhibits translation of VGAM284 host target RNA, herein designated VGAM HOST TARGET RNA, into VGAM284 host target protein, herein designated VGAM HOST TARGET PROTEIN. VGAM host target protein is therefore outlined by a broken line.

It is appreciated that VGAM284 host target gene, herein designated VGAM HOST TARGET GENE, in fact represents a plurality of VGAM284 host target genes. The mRNA of each one of this plurality of VGAM284 host target genes comprises one or more host target binding sites, each having a nucleotide sequence which is at least partly complementary to VGAM284 RNA, herein designated VGAM RNA, and which when bound by VGAM284 RNA, herein designated VGAM RNA, causes inhibition of translation of respective one or more VGAM284 host target proteins.

It is further appreciated by one skilled in the art that the mode of translational inhibition illustrated by FIG. 1 with specific reference to translational inhibition exerted by VGAM284 gene, herein designated VGAM GENE, on one or more VGAM284 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM284 is inhibition of expression of host target genes, as part of a novel viral mechanism of attacking a host. Accordingly, utilities of VGAM284 include diagnosis, prevention and treatment of viral infection by Vaccinia virus. Specific functions, and accordingly utilities, of VGAM284 correlate with, and may be deduced from, the identity of the host target genes which VGAM284 binds and inhibits, and the function of these host target genes, as elaborated hereinbelow.

Nucleotide sequences of the VGAM284 precursor RNA, herein designated VGAM PRECURSOR RNA, and of the diced VGAM284 RNA, herein designated VGAM RNA, and a schematic representation of the secondary folding of VGAM284 folded precursor RNA, herein designated VGAM FOLDED PRECURSOR RNA, of VGAM284 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM284 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 285 (VGAM285) viral gene, which modulates expression of respective host target genes thereof, the function and utility of which host target genes is known in the art.

VGAM285 is a novel bioinformatically detected regulatory, non protein coding, viral micro RNA (miRNA) gene. The method by which VGAM285 was detected is described hereinabove with reference to FIGS. 2-8.

VGAM285 gene, herein designated VGAM GENE, is a viral gene contained in the genome of Vaccinia virus. VGAM285 host target gene, herein designated VGAM HOST TARGET GENE, is a human gene contained in the human genome.

VGAM285 gene, herein designated VGAM GENE, encodes a VGAM285 precursor RNA, herein designated VGAM PRECURSOR RNA. Similar to other miRNA genes, and unlike most ordinary genes, VGAM285 precursor RNA, herein designated VGAM PRECURSOR RNA, does not encode a protein. A nucleotide sequence identical or highly similar to the nucleotide sequence of VGAM285 precursor RNA is designated SEQ ID:271, and is provided hereinbelow with reference to the sequence listing part. Nucleotide sequence SEQ ID:271 is located at position 163176 relative to the genome of Vaccinia virus.

VGAM285 precursor RNA, herein designated VGAM PRECURSOR RNA, folds onto itself, forming VGAM285 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM285 folded precursor RNA, herein designated VGAM FOLDED PRECURSOR RNA, into VGAM285 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 86%) nucleotide sequence of VGAM285 RNA is designated SEQ ID:620, and is provided hereinbelow with reference to the sequence listing part.

VGAM285 host target gene, herein designated VGAM HOST TARGET GENE, encodes a corresponding messenger RNA, VGAM285 host target RNA, herein designated VGAM HOST TARGET RNA. VGAM285 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM285 RNA, herein designated VGAM RNA, binds complementarily to one or more host target binding sites located in untranslated regions of VGAM285 host target RNA, herein designated VGAM HOST TARGET RNA. This complementary binding is due to the fact that the nucleotide sequence of VGAM285 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM285 RNA, herein designated VGAM RNA, may have a different number of host target binding sites in untranslated regions of a VGAM285 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM285 RNA, herein designated VGAM RNA, to host target binding sites on VGAM285 host target RNA, herein designated VGAM HOST TARGET RNA, such as BINDING SITE I, BINDING SITE II and BINDING SITE III, inhibits translation of VGAM285 host target RNA, herein designated VGAM HOST TARGET RNA, into VGAM285 host target protein, herein designated VGAM HOST TARGET PROTEIN. VGAM host target protein is therefore outlined by a broken line.

It is appreciated that VGAM285 host target gene, herein designated VGAM HOST TARGET GENE, in fact represents a plurality of VGAM285 host target genes. The mRNA of each one of this plurality of VGAM285 host target genes comprises one or more host target binding sites, each having a nucleotide sequence which is at least partly complementary to VGAM285 RNA, herein designated VGAM RNA, and which when bound by VGAM285 RNA, herein designated VGAM RNA, causes inhibition of translation of respective one or more VGAM285 host target proteins.

It is further appreciated by one skilled in the art that the mode of translational inhibition illustrated by FIG. 1 with specific reference to translational inhibition exerted by VGAM285 gene, herein designated VGAM GENE, on one or more VGAM285 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM285 is inhibition of expression of host target genes, as part of a novel viral mechanism of attacking a host. Accordingly, utilities of VGAM285 include diagnosis, prevention and treatment of viral infection by Vaccinia virus. Specific functions, and accordingly utilities, of VGAM285 correlate with, and may be deduced from, the identity of the host target genes which VGAM285 binds and inhibits, and the function of these host target genes, as elaborated hereinbelow.

Nucleotide sequences of the VGAM285 precursor RNA, herein designated VGAM PRECURSOR RNA, and of the diced VGAM285 RNA, herein designated VGAM RNA, and a schematic representation of the secondary folding of VGAM285 folded precursor RNA, herein designated VGAM FOLDED PRECURSOR RNA, of VGAM285 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM285 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 286 (VGAM286) viral gene, which modulates expression of respective host target genes thereof, the function and utility of which host target genes is known in the art.

VGAM286 is a novel bioinformatically detected regulatory, non protein coding, viral micro RNA (miRNA) gene. The method by which VGAM286 was detected is described hereinabove with reference to FIGS. 2-8.

VGAM286 gene, herein designated VGAM GENE, is a viral gene contained in the genome of Vaccinia virus. VGAM286 host target gene, herein designated VGAM HOST TARGET GENE, is a human gene contained in the human genome.

VGAM286 gene, herein designated VGAM GENE, encodes a VGAM286 precursor RNA, herein designated VGAM PRECURSOR RNA. Similar to other miRNA genes, and unlike most ordinary genes, VGAM286 precursor RNA, herein designated VGAM PRECURSOR RNA, does not encode a protein. A nucleotide sequence identical or highly similar to the nucleotide sequence of VGAM286 precursor RNA is designated SEQ ID:272, and is provided hereinbelow with reference to the sequence listing part. Nucleotide sequence SEQ ID:272 is located at position 163795 relative to the genome of Vaccinia virus.

VGAM286 precursor RNA, herein designated VGAM PRECURSOR RNA, folds onto itself, forming VGAM286 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM286 folded precursor RNA, herein designated VGAM FOLDED PRECURSOR RNA, into VGAM286 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM286 RNA is designated SEQ ID:621, and is provided hereinbelow with reference to the sequence listing part.

VGAM286 host target gene, herein designated VGAM HOST TARGET GENE, encodes a corresponding messenger RNA, VGAM286 host target RNA, herein designated VGAM HOST TARGET RNA. VGAM286 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM286 RNA, herein designated VGAM RNA, binds complementarily to one or more host target binding sites located in untranslated regions of VGAM286 host target RNA, herein designated VGAM HOST TARGET RNA. This complementary binding is due to the fact that the nucleotide sequence of VGAM286 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM286 RNA, herein designated VGAM RNA, may have a different number of host target binding sites in untranslated regions of a VGAM286 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM286 RNA, herein designated VGAM RNA, to host target binding sites on VGAM286 host target RNA, herein designated VGAM HOST TARGET RNA, such as BINDING SITE I, BINDING SITE II and BINDING SITE III, inhibits translation of VGAM286 host target RNA, herein designated VGAM HOST TARGET RNA, into VGAM286 host target protein, herein designated VGAM HOST TARGET PROTEIN. VGAM host target protein is therefore outlined by a broken line.

It is appreciated that VGAM286 host target gene, herein designated VGAM HOST TARGET GENE, in fact represents a plurality of VGAM286 host target genes. The mRNA of each one of this plurality of VGAM286 host target genes comprises one or more host target binding sites, each having a nucleotide sequence which is at least partly complementary to VGAM286 RNA, herein designated VGAM RNA, and which when bound by VGAM286 RNA, herein designated VGAM RNA, causes inhibition of translation of respective one or more VGAM286 host target proteins.

It is further appreciated by one skilled in the art that the mode of translational inhibition illustrated by FIG. 1 with specific reference to translational inhibition exerted by VGAM286 gene, herein designated VGAM GENE, on one or more VGAM286 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM286 is inhibition of expression of host target genes, as part of a novel viral mechanism of attacking a host. Accordingly, utilities of VGAM286 include diagnosis, prevention and treatment of viral infection by Vaccinia virus. Specific functions, and accordingly utilities, of VGAM286 correlate with, and may be deduced from, the identity of the host target genes which VGAM286 binds and inhibits, and the function of these host target genes, as elaborated hereinbelow.

Nucleotide sequences of the VGAM286 precursor RNA, herein designated VGAM PRECURSOR RNA, and of the diced VGAM286 RNA, herein designated VGAM RNA, and a schematic representation of the secondary folding of VGAM286 folded precursor RNA, herein designated VGAM FOLDED PRECURSOR RNA, of VGAM286 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM286 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 287 (VGAM287) viral gene, which modulates expression of respective host target genes thereof, the function and utility of which host target genes is known in the art.

VGAM287 is a novel bioinformatically detected regulatory, non protein coding, viral micro RNA (miRNA) gene. The method by which VGAM287 was detected is described hereinabove with reference to FIGS. 2-8.

VGAM287 gene, herein designated VGAM GENE, is a viral gene contained in the genome of Vaccinia virus. VGAM287 host target gene, herein designated VGAM HOST TARGET GENE, is a human gene contained in the human genome.

VGAM287 gene, herein designated VGAM GENE, encodes a VGAM287 precursor RNA, herein designated VGAM PRECURSOR RNA. Similar to other miRNA genes, and unlike most ordinary genes, VGAM287 precursor RNA, herein designated VGAM PRECURSOR RNA, does not encode a protein. A nucleotide sequence identical or highly similar to the nucleotide sequence of VGAM287 precursor RNA is designated SEQ ID:273, and is provided hereinbelow with reference to the sequence listing part. Nucleotide sequence SEQ ID:273 is located at position 163852 relative to the genome of Vaccinia virus.

VGAM287 precursor RNA, herein designated VGAM PRECURSOR RNA, folds onto itself, forming VGAM287 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM287 folded precursor RNA, herein designated VGAM FOLDED PRECURSOR RNA, into VGAM287 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM287 RNA is designated SEQ ID:622, and is provided hereinbelow with reference to the sequence listing part.

VGAM287 host target gene, herein designated VGAM HOST TARGET GENE, encodes a corresponding messenger RNA, VGAM287 host target RNA, herein designated VGAM HOST TARGET RNA. VGAM287 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM287 RNA, herein designated VGAM RNA, binds complementarily to one or more host target binding sites located in untranslated regions of VGAM287 host target RNA, herein designated VGAM HOST TARGET RNA. This complementary binding is due to the fact that the nucleotide sequence of VGAM287 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM287 RNA, herein designated VGAM RNA, may have a different number of host target binding sites in untranslated regions of a VGAM287 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM287 RNA, herein designated VGAM RNA, to host target binding sites on VGAM287 host target RNA, herein designated VGAM HOST TARGET RNA, such as BINDING SITE I, BINDING SITE II and BINDING SITE III, inhibits translation of VGAM287 host target RNA, herein designated VGAM HOST TARGET RNA, into VGAM287 host target protein, herein designated VGAM HOST TARGET PROTEIN. VGAM host target protein is therefore outlined by a broken line.

It is appreciated that VGAM287 host target gene, herein designated VGAM HOST TARGET GENE, in fact represents a plurality of VGAM287 host target genes. The mRNA of each one of this plurality of VGAM287 host target genes comprises one or more host target binding sites, each having a nucleotide sequence which is at least partly complementary to VGAM287 RNA, herein designated VGAM RNA, and which when bound by VGAM287 RNA, herein designated VGAM RNA, causes inhibition of translation of respective one or more VGAM287 host target proteins.

It is further appreciated by one skilled in the art that the mode of translational inhibition illustrated by FIG. 1 with specific reference to translational inhibition exerted by VGAM287 gene, herein designated VGAM GENE, on one or more VGAM287 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM287 is inhibition of expression of host target genes, as part of a novel viral mechanism of attacking a host. Accordingly, utilities of VGAM287 include diagnosis, prevention and treatment of viral infection by Vaccinia virus. Specific functions, and accordingly utilities, of VGAM287 correlate with, and may be deduced from, the identity of the host target genes which VGAM287 binds and inhibits, and the function of these host target genes, as elaborated hereinbelow.

Nucleotide sequences of the VGAM287 precursor RNA, herein designated VGAM PRECURSOR RNA, and of the diced VGAM287 RNA, herein designated VGAM RNA, and a schematic representation of the secondary folding of VGAM287 folded precursor RNA, herein designated VGAM FOLDED PRECURSOR RNA, of VGAM287 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM287 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 288 (VGAM288) viral gene, which modulates expression of respective host target genes thereof, the function and utility of which host target genes is known in the art.

VGAM288 is a novel bioinformatically detected regulatory, non protein coding, viral micro RNA (miRNA) gene. The method by which VGAM288 was detected is described hereinabove with reference to FIGS. 2-8.

VGAM288 gene, herein designated VGAM GENE, is a viral gene contained in the genome of Vaccinia virus. VGAM288 host target gene, herein designated VGAM HOST TARGET GENE, is a human gene contained in the human genome.

VGAM288 gene, herein designated VGAM GENE, encodes a VGAM288 precursor RNA, herein designated VGAM PRECURSOR RNA. Similar to other miRNA genes, and unlike most ordinary genes, VGAM288 precursor RNA, herein designated VGAM PRECURSOR RNA, does not encode a protein. A nucleotide sequence identical or highly similar to the nucleotide sequence of VGAM288 precursor RNA is designated SEQ ID:274, and is provided hereinbelow with reference to the sequence listing part. Nucleotide sequence SEQ ID:274 is located at position 166608 relative to the genome of Vaccinia virus.

VGAM288 precursor RNA, herein designated VGAM PRECURSOR RNA, folds onto itself, forming VGAM288 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM288 folded precursor RNA, herein designated VGAM FOLDED PRECURSOR RNA, into VGAM288 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM288 RNA is designated SEQ ID:623, and is provided hereinbelow with reference to the sequence listing part.

VGAM288 host target gene, herein designated VGAM HOST TARGET GENE, encodes a corresponding messenger RNA, VGAM288 host target RNA, herein designated VGAM HOST TARGET RNA. VGAM288 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM288 RNA, herein designated VGAM RNA, binds complementarily to one or more host target binding sites located in untranslated regions of VGAM288 host target RNA, herein designated VGAM HOST TARGET RNA. This complementary binding is due to the fact that the nucleotide sequence of VGAM288 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM288 RNA, herein designated VGAM RNA, may have a different number of host target binding sites in untranslated regions of a VGAM288 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM288 RNA, herein designated VGAM RNA, to host target binding sites on VGAM288 host target RNA, herein designated VGAM HOST TARGET RNA, such as BINDING SITE I, BINDING SITE II and BINDING SITE III, inhibits translation of VGAM288 host target RNA, herein designated VGAM HOST TARGET RNA, into VGAM288 host target protein, herein designated VGAM HOST TARGET PROTEIN. VGAM host target protein is therefore outlined by a broken line.

It is appreciated that VGAM288 host target gene, herein designated VGAM HOST TARGET GENE, in fact represents a plurality of VGAM288 host target genes. The mRNA of each one of this plurality of VGAM288 host target genes comprises one or more host target binding sites, each having a nucleotide sequence which is at least partly complementary to VGAM288 RNA, herein designated VGAM RNA, and which when bound by VGAM288 RNA, herein designated VGAM RNA, causes inhibition of translation of respective one or more VGAM288 host target proteins.

It is further appreciated by one skilled in the art that the mode of translational inhibition illustrated by FIG. 1 with specific reference to translational inhibition exerted by VGAM288 gene, herein designated VGAM GENE, on one or more VGAM288 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM288 is inhibition of expression of host target genes, as part of a novel viral mechanism of attacking a host. Accordingly, utilities of VGAM288 include diagnosis, prevention and treatment of viral infection by Vaccinia virus. Specific functions, and accordingly utilities, of VGAM288 correlate with, and may be deduced from, the identity of the host target genes which VGAM288 binds and inhibits, and the function of these host target genes, as elaborated hereinbelow.

Nucleotide sequences of the VGAM288 precursor RNA, herein designated VGAM PRECURSOR RNA, and of the diced VGAM288 RNA, herein designated VGAM RNA, and a schematic representation of the secondary folding of VGAM288 folded precursor RNA, herein designated VGAM FOLDED PRECURSOR RNA, of VGAM288 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM288 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 289 (VGAM289) viral gene, which modulates expression of respective host target genes thereof, the function and utility of which host target genes is known in the art.

VGAM289 is a novel bioinformatically detected regulatory, non protein coding, viral micro RNA (miRNA) gene. The method by which VGAM289 was detected is described hereinabove with reference to FIGS. 2-8.

VGAM289 gene, herein designated VGAM GENE, is a viral gene contained in the genome of Vaccinia virus. VGAM289 host target gene, herein designated VGAM HOST TARGET GENE, is a human gene contained in the human genome.

VGAM289 gene, herein designated VGAM GENE, encodes a VGAM289 precursor RNA, herein designated VGAM PRECURSOR RNA. Similar to other miRNA genes, and unlike most ordinary genes, VGAM289 precursor RNA, herein designated VGAM PRECURSOR RNA, does not encode a protein. A nucleotide sequence identical or highly similar to the nucleotide sequence of VGAM289 precursor RNA is designated SEQ ID:275, and is provided hereinbelow with reference to the sequence listing part. Nucleotide sequence SEQ ID:275 is located at position 168231 relative to the genome of Vaccinia virus.

VGAM289 precursor RNA, herein designated VGAM PRECURSOR RNA, folds onto itself, forming VGAM289 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM289 folded precursor RNA, herein designated VGAM FOLDED PRECURSOR RNA, into VGAM289 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 87%) nucleotide sequence of VGAM289 RNA is designated SEQ ID:624, and is provided hereinbelow with reference to the sequence listing part.

VGAM289 host target gene, herein designated VGAM HOST TARGET GENE, encodes a corresponding messenger RNA, VGAM289 host target RNA, herein designated VGAM HOST TARGET RNA. VGAM289 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM289 RNA, herein designated VGAM RNA, binds complementarily to one or more host target binding sites located in untranslated regions of VGAM289 host target RNA, herein designated VGAM HOST TARGET RNA. This complementary binding is due to the fact that the nucleotide sequence of VGAM289 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM289 RNA, herein designated VGAM RNA, may have a different number of host target binding sites in untranslated regions of a VGAM289 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM289 RNA, herein designated VGAM RNA, to host target binding sites on VGAM289 host target RNA, herein designated VGAM HOST TARGET RNA, such as BINDING SITE I, BINDING SITE II and BINDING SITE III, inhibits translation of VGAM289 host target RNA, herein designated VGAM HOST TARGET RNA, into VGAM289 host target protein, herein designated VGAM HOST TARGET PROTEIN. VGAM host target protein is therefore outlined by a broken line.

It is appreciated that VGAM289 host target gene, herein designated VGAM HOST TARGET GENE, in fact represents a plurality of VGAM289 host target genes. The mRNA of each one of this plurality of VGAM289 host target genes comprises one or more host target binding sites, each having a nucleotide sequence which is at least partly complementary to VGAM289 RNA, herein designated VGAM RNA, and which when bound by VGAM289 RNA, herein designated VGAM RNA, causes inhibition of translation of respective one or more VGAM289 host target proteins.

It is further appreciated by one skilled in the art that the mode of translational inhibition illustrated by FIG. 1 with specific reference to translational inhibition exerted by VGAM289 gene, herein designated VGAM GENE, on one or more VGAM289 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM289 is inhibition of expression of host target genes, as part of a novel viral mechanism of attacking a host. Accordingly, utilities of VGAM289 include diagnosis, prevention and treatment of viral infection by Vaccinia virus. Specific functions, and accordingly utilities, of VGAM289 correlate with, and may be deduced from, the identity of the host target genes which VGAM289 binds and inhibits, and the function of these host target genes, as elaborated hereinbelow.

Nucleotide sequences of the VGAM289 precursor RNA, herein designated VGAM PRECURSOR RNA, and of the diced VGAM289 RNA, herein designated VGAM RNA, and a schematic representation of the secondary folding of VGAM289 folded precursor RNA, herein designated VGAM FOLDED PRECURSOR RNA, of VGAM289 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM289 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 290 (VGAM290) viral gene, which modulates expression of respective host target genes thereof, the function and utility of which host target genes is known in the art.

VGAM290 is a novel bioinformatically detected regulatory, non protein coding, viral micro RNA (miRNA) gene. The method by which VGAM290 was detected is described hereinabove with reference to FIGS. 2-8.

VGAM290 gene, herein designated VGAM GENE, is a viral gene contained in the genome of Vaccinia virus. VGAM290 host target gene, herein designated VGAM HOST TARGET GENE, is a human gene contained in the human genome.

VGAM290 gene, herein designated VGAM GENE, encodes a VGAM290 precursor RNA, herein designated VGAM PRECURSOR RNA. Similar to other miRNA genes, and unlike most ordinary genes, VGAM290 precursor RNA, herein designated VGAM PRECURSOR RNA, does not encode a protein. A nucleotide sequence identical or highly similar to the nucleotide sequence of VGAM290 precursor RNA is designated SEQ ID:276, and is provided hereinbelow with reference to the sequence listing part. Nucleotide sequence SEQ ID:276 is located at position 166723 relative to the genome of Vaccinia virus.

VGAM290 precursor RNA, herein designated VGAM PRECURSOR RNA, folds onto itself, forming VGAM290 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM290 folded precursor RNA, herein designated VGAM FOLDED PRECURSOR RNA, into VGAM290 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM290 RNA is designated SEQ ID:625, and is provided hereinbelow with reference to the sequence listing part.

VGAM290 host target gene, herein designated VGAM HOST TARGET GENE, encodes a corresponding messenger RNA, VGAM290 host target RNA, herein designated VGAM HOST TARGET RNA. VGAM290 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM290 RNA, herein designated VGAM RNA, binds complementarily to one or more host target binding sites located in untranslated regions of VGAM290 host target RNA, herein designated VGAM HOST TARGET RNA. This complementary binding is due to the fact that the nucleotide sequence of VGAM290 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM290 RNA, herein designated VGAM RNA, may have a different number of host target binding sites in untranslated regions of a VGAM290 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM290 RNA, herein designated VGAM RNA, to host target binding sites on VGAM290 host target RNA, herein designated VGAM HOST TARGET RNA, such as BINDING SITE I, BINDING SITE II and BINDING SITE III, inhibits translation of VGAM290 host target RNA, herein designated VGAM HOST TARGET RNA, into VGAM290 host target protein, herein designated VGAM HOST TARGET PROTEIN. VGAM host target protein is therefore outlined by a broken line.

It is appreciated that VGAM290 host target gene, herein designated VGAM HOST TARGET GENE, in fact represents a plurality of VGAM290 host target genes. The mRNA of each one of this plurality of VGAM290 host target genes comprises one or more host target binding sites, each having a nucleotide sequence which is at least partly complementary to VGAM290 RNA, herein designated VGAM RNA, and which when bound by VGAM290 RNA, herein designated VGAM RNA, causes inhibition of translation of respective one or more VGAM290 host target proteins.

It is further appreciated by one skilled in the art that the mode of translational inhibition illustrated by FIG. 1 with specific reference to translational inhibition exerted by VGAM290 gene, herein designated VGAM GENE, on one or more VGAM290 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM290 is inhibition of expression of host target genes, as part of a novel viral mechanism of attacking a host. Accordingly, utilities of VGAM290 include diagnosis, prevention and treatment of viral infection by Vaccinia virus. Specific functions, and accordingly utilities, of VGAM290 correlate with, and may be deduced from, the identity of the host target genes which VGAM290 binds and inhibits, and the function of these host target genes, as elaborated hereinbelow.

Nucleotide sequences of the VGAM290 precursor RNA, herein designated VGAM PRECURSOR RNA, and of the diced VGAM290 RNA, herein designated VGAM RNA, and a schematic representation of the secondary folding of VGAM290 folded precursor RNA, herein designated VGAM FOLDED PRECURSOR RNA, of VGAM290 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM290 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 291 (VGAM291) viral gene, which modulates expression of respective host target genes thereof, the function and utility of which host target genes is known in the art.

VGAM291 is a novel bioinformatically detected regulatory, non protein coding, viral micro RNA (miRNA) gene. The method by which VGAM291 was detected is described hereinabove with reference to FIGS. 2-8.

VGAM291 gene, herein designated VGAM GENE, is a viral gene contained in the genome of Vaccinia virus. VGAM291 host target gene, herein designated VGAM HOST TARGET GENE, is a human gene contained in the human genome.

VGAM291 gene, herein designated VGAM GENE, encodes a VGAM291 precursor RNA, herein designated VGAM PRECURSOR RNA. Similar to other miRNA genes, and unlike most ordinary genes, VGAM291 precursor RNA, herein designated VGAM PRECURSOR RNA, does not encode a protein. A nucleotide sequence identical or highly similar to the nucleotide sequence of VGAM291 precursor RNA is designated SEQ ID:277, and is provided hereinbelow with reference to the sequence listing part. Nucleotide sequence SEQ ID:277 is located at position 165333 relative to the genome of Vaccinia virus.

VGAM291 precursor RNA, herein designated VGAM PRECURSOR RNA, folds onto itself, forming VGAM291 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM291 folded precursor RNA, herein designated VGAM FOLDED PRECURSOR RNA, into VGAM291 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 79%) nucleotide sequence of VGAM291 RNA is designated SEQ ID:626, and is provided hereinbelow with reference to the sequence listing part.

VGAM291 host target gene, herein designated VGAM HOST TARGET GENE, encodes a corresponding messenger RNA, VGAM291 host target RNA, herein designated VGAM HOST TARGET RNA. VGAM291 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM291 RNA, herein designated VGAM RNA, binds complementarily to one or more host target binding sites located in untranslated regions of VGAM291 host target RNA, herein designated VGAM HOST TARGET RNA. This complementary binding is due to the fact that the nucleotide sequence of VGAM291 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM291 RNA, herein designated VGAM RNA, may have a different number of host target binding sites in untranslated regions of a VGAM291 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM291 RNA, herein designated VGAM RNA, to host target binding sites on VGAM291 host target RNA, herein designated VGAM HOST TARGET RNA, such as BINDING SITE I, BINDING SITE II and BINDING SITE III, inhibits translation of VGAM291 host target RNA, herein designated VGAM HOST TARGET RNA, into VGAM291 host target protein, herein designated VGAM HOST TARGET PROTEIN. VGAM host target protein is therefore outlined by a broken line.

It is appreciated that VGAM291 host target gene, herein designated VGAM HOST TARGET GENE, in fact represents a plurality of VGAM291 host target genes. The mRNA of each one of this plurality of VGAM291 host target genes comprises one or more host target binding sites, each having a nucleotide sequence which is at least partly complementary to VGAM291 RNA, herein designated VGAM RNA, and which when bound by VGAM291 RNA, herein designated VGAM RNA, causes inhibition of translation of respective one or more VGAM291 host target proteins.

It is further appreciated by one skilled in the art that the mode of translational inhibition illustrated by FIG. 1 with specific reference to translational inhibition exerted by VGAM291 gene, herein designated VGAM GENE, on one or more VGAM291 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM291 is inhibition of expression of host target genes, as part of a novel viral mechanism of attacking a host. Accordingly, utilities of VGAM291 include diagnosis, prevention and treatment of viral infection by Vaccinia virus. Specific functions, and accordingly utilities, of VGAM291 correlate with, and may be deduced from, the identity of the host target genes which VGAM291 binds and inhibits, and the function of these host target genes, as elaborated hereinbelow.

Nucleotide sequences of the VGAM291 precursor RNA, herein designated VGAM PRECURSOR RNA, and of the diced VGAM291 RNA, herein designated VGAM RNA, and a schematic representation of the secondary folding of VGAM291 folded precursor RNA, herein designated VGAM FOLDED PRECURSOR RNA, of VGAM291 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM291 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 292 (VGAM292) viral gene, which modulates expression of respective host target genes thereof, the function and utility of which host target genes is known in the art.

VGAM292 is a novel bioinformatically detected regulatory, non protein coding, viral micro RNA (miRNA) gene. The method by which VGAM292 was detected is described hereinabove with reference to FIGS. 2-8.

VGAM292 gene, herein designated VGAM GENE, is a viral gene contained in the genome of Vaccinia virus. VGAM292 host target gene, herein designated VGAM HOST TARGET GENE, is a human gene contained in the human genome.

VGAM292 gene, herein designated VGAM GENE, encodes a VGAM292 precursor RNA, herein designated VGAM PRECURSOR RNA. Similar to other miRNA genes, and unlike most ordinary genes, VGAM292 precursor RNA, herein designated VGAM PRECURSOR RNA, does not encode a protein. A nucleotide sequence identical or highly similar to the nucleotide sequence of VGAM292 precursor RNA is designated SEQ ID:278, and is provided hereinbelow with reference to the sequence listing part. Nucleotide sequence SEQ ID:278 is located at position 165010 relative to the genome of Vaccinia virus.

VGAM292 precursor RNA, herein designated VGAM PRECURSOR RNA, folds onto itself, forming VGAM292 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM292 folded precursor RNA, herein designated VGAM FOLDED PRECURSOR RNA, into VGAM292 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM292 RNA is designated SEQ ID:627, and is provided hereinbelow with reference to the sequence listing part.

VGAM292 host target gene, herein designated VGAM HOST TARGET GENE, encodes a corresponding messenger RNA, VGAM292 host target RNA, herein designated VGAM HOST TARGET RNA. VGAM292 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM292 RNA, herein designated VGAM RNA, binds complementarily to one or more host target binding sites located in untranslated regions of VGAM292 host target RNA, herein designated VGAM HOST TARGET RNA. This complementary binding is due to the fact that the nucleotide sequence of VGAM292 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM292 RNA, herein designated VGAM RNA, may have a different number of host target binding sites in untranslated regions of a VGAM292 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM292 RNA, herein designated VGAM RNA, to host target binding sites on VGAM292 host target RNA, herein designated VGAM HOST TARGET RNA, such as BINDING SITE I, BINDING SITE II and BINDING SITE III, inhibits translation of VGAM292 host target RNA, herein designated VGAM HOST TARGET RNA, into VGAM292 host target protein, herein designated VGAM HOST TARGET PROTEIN. VGAM host target protein is therefore outlined by a broken line.

It is appreciated that VGAM292 host target gene, herein designated VGAM HOST TARGET GENE, in fact represents a plurality of VGAM292 host target genes. The mRNA of each one of this plurality of VGAM292 host target genes comprises one or more host target binding sites, each having a nucleotide sequence which is at least partly complementary to VGAM292 RNA, herein designated VGAM RNA, and which when bound by VGAM292 RNA, herein designated VGAM RNA, causes inhibition of translation of respective one or more VGAM292 host target proteins.

It is further appreciated by one skilled in the art that the mode of translational inhibition illustrated by FIG. 1 with specific reference to translational inhibition exerted by VGAM292 gene, herein designated VGAM GENE, on one or more VGAM292 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM292 is inhibition of expression of host target genes, as part of a novel viral mechanism of attacking a host. Accordingly, utilities of VGAM292 include diagnosis, prevention and treatment of viral infection by Vaccinia virus. Specific functions, and accordingly utilities, of VGAM292 correlate with, and may be deduced from, the identity of the host target genes which VGAM292 binds and inhibits, and the function of these host target genes, as elaborated hereinbelow.

Nucleotide sequences of the VGAM292 precursor RNA, herein designated VGAM PRECURSOR RNA, and of the diced VGAM292 RNA, herein designated VGAM RNA, and a schematic representation of the secondary folding of VGAM292 folded precursor RNA, herein designated VGAM FOLDED PRECURSOR RNA, of VGAM292 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM292 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 293 (VGAM293) viral gene, which modulates expression of respective host target genes thereof, the function and utility of which host target genes is known in the art.

VGAM293 is a novel bioinformatically detected regulatory, non protein coding, viral micro RNA (miRNA) gene. The method by which VGAM293 was detected is described hereinabove with reference to FIGS. 2-8.

VGAM293 gene, herein designated VGAM GENE, is a viral gene contained in the genome of Vaccinia virus. VGAM293 host target gene, herein designated VGAM HOST TARGET GENE, is a human gene contained in the human genome.

VGAM293 gene, herein designated VGAM GENE, encodes a VGAM293 precursor RNA, herein designated VGAM PRECURSOR RNA. Similar to other miRNA genes, and unlike most ordinary genes, VGAM293 precursor RNA, herein designated VGAM PRECURSOR RNA, does not encode a protein. A nucleotide sequence identical or highly similar to the nucleotide sequence of VGAM293 precursor RNA is designated SEQ ID:279, and is provided hereinbelow with reference to the sequence listing part. Nucleotide sequence SEQ ID:279 is located at position 165185 relative to the genome of Vaccinia virus.

VGAM293 precursor RNA, herein designated VGAM PRECURSOR RNA, folds onto itself, forming VGAM293 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM293 folded precursor RNA, herein designated VGAM FOLDED PRECURSOR RNA, into VGAM293 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 72%) nucleotide sequence of VGAM293 RNA is designated SEQ ID:628, and is provided hereinbelow with reference to the sequence listing part.

VGAM293 host target gene, herein designated VGAM HOST TARGET GENE, encodes a corresponding messenger RNA, VGAM293 host target RNA, herein designated VGAM HOST TARGET RNA. VGAM293 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM293 RNA, herein designated VGAM RNA, binds complementarily to one or more host target binding sites located in untranslated regions of VGAM293 host target RNA, herein designated VGAM HOST TARGET RNA. This complementary binding is due to the fact that the nucleotide sequence of VGAM293 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM293 RNA, herein designated VGAM RNA, may have a different number of host target binding sites in untranslated regions of a VGAM293 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM293 RNA, herein designated VGAM RNA, to host target binding sites on VGAM293 host target RNA, herein designated VGAM HOST TARGET RNA, such as BINDING SITE I, BINDING SITE II and BINDING SITE III, inhibits translation of VGAM293 host target RNA, herein designated VGAM HOST TARGET RNA, into VGAM293 host target protein, herein designated VGAM HOST TARGET PROTEIN. VGAM host target protein is therefore outlined by a broken line.

It is appreciated that VGAM293 host target gene, herein designated VGAM HOST TARGET GENE, in fact represents a plurality of VGAM293 host target genes. The mRNA of each one of this plurality of VGAM293 host target genes comprises one or more host target binding sites, each having a nucleotide sequence which is at least partly complementary to VGAM293 RNA, herein designated VGAM RNA, and which when bound by VGAM293 RNA, herein designated VGAM RNA, causes inhibition of translation of respective one or more VGAM293 host target proteins.

It is further appreciated by one skilled in the art that the mode of translational inhibition illustrated by FIG. 1 with specific reference to translational inhibition exerted by VGAM293 gene, herein designated VGAM GENE, on one or more VGAM293 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM293 is inhibition of expression of host target genes, as part of a novel viral mechanism of attacking a host. Accordingly, utilities of VGAM293 include diagnosis, prevention and treatment of viral infection by Vaccinia virus. Specific functions, and accordingly utilities, of VGAM293 correlate with, and may be deduced from, the identity of the host target genes which VGAM293 binds and inhibits, and the function of these host target genes, as elaborated hereinbelow.

Nucleotide sequences of the VGAM293 precursor RNA, herein designated VGAM PRECURSOR RNA, and of the diced VGAM293 RNA, herein designated VGAM RNA, and a schematic representation of the secondary folding of VGAM293 folded precursor RNA, herein designated VGAM FOLDED PRECURSOR RNA, of VGAM293 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM293 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 294 (VGAM294) viral gene, which modulates expression of respective host target genes thereof, the function and utility of which host target genes is known in the art.

VGAM294 is a novel bioinformatically detected regulatory, non protein coding, viral micro RNA (miRNA) gene. The method by which VGAM294 was detected is described hereinabove with reference to FIGS. 2-8.

VGAM294 gene, herein designated VGAM GENE, is a viral gene contained in the genome of Vaccinia virus. VGAM294 host target gene, herein designated VGAM HOST TARGET GENE, is a human gene contained in the human genome.

VGAM294 gene, herein designated VGAM GENE, encodes a VGAM294 precursor RNA, herein designated VGAM PRECURSOR RNA. Similar to other miRNA genes, and unlike most ordinary genes, VGAM294 precursor RNA, herein designated VGAM PRECURSOR RNA, does not encode a protein. A nucleotide sequence identical or highly similar to the nucleotide sequence of VGAM294 precursor RNA is designated SEQ ID:280, and is provided hereinbelow with reference to the sequence listing part. Nucleotide sequence SEQ ID:280 is located at position 165538 relative to the genome of Vaccinia virus.

VGAM294 precursor RNA, herein designated VGAM PRECURSOR RNA, folds onto itself, forming VGAM294 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM294 folded precursor RNA, herein designated VGAM FOLDED PRECURSOR RNA, into VGAM294 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 90%) nucleotide sequence of VGAM294 RNA is designated SEQ ID:629, and is provided hereinbelow with reference to the sequence listing part.

VGAM294 host target gene, herein designated VGAM HOST TARGET GENE, encodes a corresponding messenger RNA, VGAM294 host target RNA, herein designated VGAM HOST TARGET RNA. VGAM294 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM294 RNA, herein designated VGAM RNA, binds complementarily to one or more host target binding sites located in untranslated regions of VGAM294 host target RNA, herein designated VGAM HOST TARGET RNA. This complementary binding is due to the fact that the nucleotide sequence of VGAM294 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM294 RNA, herein designated VGAM RNA, may have a different number of host target binding sites in untranslated regions of a VGAM294 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM294 RNA, herein designated VGAM RNA, to host target binding sites on VGAM294 host target RNA, herein designated VGAM HOST TARGET RNA, such as BINDING SITE I, BINDING SITE II and BINDING SITE III, inhibits translation of VGAM294 host target RNA, herein designated VGAM HOST TARGET RNA, into VGAM294 host target protein, herein designated VGAM HOST TARGET PROTEIN. VGAM host target protein is therefore outlined by a broken line.

It is appreciated that VGAM294 host target gene, herein designated VGAM HOST TARGET GENE, in fact represents a plurality of VGAM294 host target genes. The mRNA of each one of this plurality of VGAM294 host target genes comprises one or more host target binding sites, each having a nucleotide sequence which is at least partly complementary to VGAM294 RNA, herein designated VGAM RNA, and which when bound by VGAM294 RNA, herein designated VGAM RNA, causes inhibition of translation of respective one or more VGAM294 host target proteins.

It is further appreciated by one skilled in the art that the mode of translational inhibition illustrated by FIG. 1 with specific reference to translational inhibition exerted by VGAM294 gene, herein designated VGAM GENE, on one or more VGAM294 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM294 is inhibition of expression of host target genes, as part of a novel viral mechanism of attacking a host. Accordingly, utilities of VGAM294 include diagnosis, prevention and treatment of viral infection by Vaccinia virus. Specific functions, and accordingly utilities, of VGAM294 correlate with, and may be deduced from, the identity of the host target genes which VGAM294 binds and inhibits, and the function of these host target genes, as elaborated hereinbelow.

Nucleotide sequences of the VGAM294 precursor RNA, herein designated VGAM PRECURSOR RNA, and of the diced VGAM294 RNA, herein designated VGAM RNA, and a schematic representation of the secondary folding of VGAM294 folded precursor RNA, herein designated VGAM FOLDED PRECURSOR RNA, of VGAM294 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM294 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 295 (VGAM295) viral gene, which modulates expression of respective host target genes thereof, the function and utility of which host target genes is known in the art.

VGAM295 is a novel bioinformatically detected regulatory, non protein coding, viral micro RNA (miRNA) gene. The method by which VGAM295 was detected is described hereinabove with reference to FIGS. 2-8.

VGAM295 gene, herein designated VGAM GENE, is a viral gene contained in the genome of Vaccinia virus. VGAM295 host target gene, herein designated VGAM HOST TARGET GENE, is a human gene contained in the human genome.

VGAM295 gene, herein designated VGAM GENE, encodes a VGAM295 precursor RNA, herein designated VGAM PRECURSOR RNA. Similar to other miRNA genes, and unlike most ordinary genes, VGAM295 precursor RNA, herein designated VGAM PRECURSOR RNA, does not encode a protein. A nucleotide sequence identical or highly similar to the nucleotide sequence of VGAM295 precursor RNA is designated SEQ ID:281, and is provided hereinbelow with reference to the sequence listing part. Nucleotide sequence SEQ ID:281 is located at position 172682 relative to the genome of Vaccinia virus.

VGAM295 precursor RNA, herein designated VGAM PRECURSOR RNA, folds onto itself, forming VGAM295 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM295 folded precursor RNA, herein designated VGAM FOLDED PRECURSOR RNA, into VGAM295 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 72%) nucleotide sequence of VGAM295 RNA is designated SEQ ID:630, and is provided hereinbelow with reference to the sequence listing part.

VGAM295 host target gene, herein designated VGAM HOST TARGET GENE, encodes a corresponding messenger RNA, VGAM295 host target RNA, herein designated VGAM HOST TARGET RNA. VGAM295 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM295 RNA, herein designated VGAM RNA, binds complementarily to one or more host target binding sites located in untranslated regions of VGAM295 host target RNA, herein designated VGAM HOST TARGET RNA. This complementary binding is due to the fact that the nucleotide sequence of VGAM295 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM295 RNA, herein designated VGAM RNA, may have a different number of host target binding sites in untranslated regions of a VGAM295 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM295 RNA, herein designated VGAM RNA, to host target binding sites on VGAM295 host target RNA, herein designated VGAM HOST TARGET RNA, such as BINDING SITE I, BINDING SITE II and BINDING SITE III, inhibits translation of VGAM295 host target RNA, herein designated VGAM HOST TARGET RNA, into VGAM295 host target protein, herein designated VGAM HOST TARGET PROTEIN. VGAM host target protein is therefore outlined by a broken line.

It is appreciated that VGAM295 host target gene, herein designated VGAM HOST TARGET GENE, in fact represents a plurality of VGAM295 host target genes. The mRNA of each one of this plurality of VGAM295 host target genes comprises one or more host target binding sites, each having a nucleotide sequence which is at least partly complementary to VGAM295 RNA, herein designated VGAM RNA, and which when bound by VGAM295 RNA, herein designated VGAM RNA, causes inhibition of translation of respective one or more VGAM295 host target proteins.

It is further appreciated by one skilled in the art that the mode of translational inhibition illustrated by FIG. 1 with specific reference to translational inhibition exerted by VGAM295 gene, herein designated VGAM GENE, on one or more VGAM295 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM295 is inhibition of expression of host target genes, as part of a novel viral mechanism of attacking a host. Accordingly, utilities of VGAM295 include diagnosis, prevention and treatment of viral infection by Vaccinia virus. Specific functions, and accordingly utilities, of VGAM295 correlate with, and may be deduced from, the identity of the host target genes which VGAM295 binds and inhibits, and the function of these host target genes, as elaborated hereinbelow.

Nucleotide sequences of the VGAM295 precursor RNA, herein designated VGAM PRECURSOR RNA, and of the diced VGAM295 RNA, herein designated VGAM RNA, and a schematic representation of the secondary folding of VGAM295 folded precursor RNA, herein designated VGAM FOLDED PRECURSOR RNA, of VGAM295 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM295 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 296 (VGAM296) viral gene, which modulates expression of respective host target genes thereof, the function and utility of which host target genes is known in the art.

VGAM296 is a novel bioinformatically detected regulatory, non protein coding, viral micro RNA (miRNA) gene. The method by which VGAM296 was detected is described hereinabove with reference to FIGS. 2-8.

VGAM296 gene, herein designated VGAM GENE, is a viral gene contained in the genome of Vaccinia virus. VGAM296 host target gene, herein designated VGAM HOST TARGET GENE, is a human gene contained in the human genome.

VGAM296 gene, herein designated VGAM GENE, encodes a VGAM296 precursor RNA, herein designated VGAM PRECURSOR RNA. Similar to other miRNA genes, and unlike most ordinary genes, VGAM296 precursor RNA, herein designated VGAM PRECURSOR RNA, does not encode a protein. A nucleotide sequence identical or highly similar to the nucleotide sequence of VGAM296 precursor RNA is designated SEQ ID:282, and is provided hereinbelow with reference to the sequence listing part. Nucleotide sequence SEQ ID:282 is located at position 169865 relative to the genome of Vaccinia virus.

VGAM296 precursor RNA, herein designated VGAM PRECURSOR RNA, folds onto itself, forming VGAM296 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM296 folded precursor RNA, herein designated VGAM FOLDED PRECURSOR RNA, into VGAM296 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM296 RNA is designated SEQ ID:631, and is provided hereinbelow with reference to the sequence listing part.

VGAM296 host target gene, herein designated VGAM HOST TARGET GENE, encodes a corresponding messenger RNA, VGAM296 host target RNA, herein designated VGAM HOST TARGET RNA. VGAM296 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM296 RNA, herein designated VGAM RNA, binds complementarily to one or more host target binding sites located in untranslated regions of VGAM296 host target RNA, herein designated VGAM HOST TARGET RNA. This complementary binding is due to the fact that the nucleotide sequence of VGAM296 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM296 RNA, herein designated VGAM RNA, may have a different number of host target binding sites in untranslated regions of a VGAM296 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM296 RNA, herein designated VGAM RNA, to host target binding sites on VGAM296 host target RNA, herein designated VGAM HOST TARGET RNA, such as BINDING SITE I, BINDING SITE II and BINDING SITE III, inhibits translation of VGAM296 host target RNA, herein designated VGAM HOST TARGET RNA, into VGAM296 host target protein, herein designated VGAM HOST TARGET PROTEIN. VGAM host target protein is therefore outlined by a broken line.

It is appreciated that VGAM296 host target gene, herein designated VGAM HOST TARGET GENE, in fact represents a plurality of VGAM296 host target genes. The mRNA of each one of this plurality of VGAM296 host target genes comprises one or more host target binding sites, each having a nucleotide sequence which is at least partly complementary to VGAM296 RNA, herein designated VGAM RNA, and which when bound by VGAM296 RNA, herein designated VGAM RNA, causes inhibition of translation of respective one or more VGAM296 host target proteins.

It is further appreciated by one skilled in the art that the mode of translational inhibition illustrated by FIG. 1 with specific reference to translational inhibition exerted by VGAM296 gene, herein designated VGAM GENE, on one or more VGAM296 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM296 is inhibition of expression of host target genes, as part of a novel viral mechanism of attacking a host. Accordingly, utilities of VGAM296 include diagnosis, prevention and treatment of viral infection by Vaccinia virus. Specific functions, and accordingly utilities, of VGAM296 correlate with, and may be deduced from, the identity of the host target genes which VGAM296 binds and inhibits, and the function of these host target genes, as elaborated hereinbelow.

Nucleotide sequences of the VGAM296 precursor RNA, herein designated VGAM PRECURSOR RNA, and of the diced VGAM296 RNA, herein designated VGAM RNA, and a schematic representation of the secondary folding of VGAM296 folded precursor RNA, herein designated VGAM FOLDED PRECURSOR RNA, of VGAM296 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM296 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 297 (VGAM297) viral gene, which modulates expression of respective host target genes thereof, the function and utility of which host target genes is known in the art.

VGAM297 is a novel bioinformatically detected regulatory, non protein coding, viral micro RNA (miRNA) gene. The method by which VGAM297 was detected is described hereinabove with reference to FIGS. 2-8.

VGAM297 gene, herein designated VGAM GENE, is a viral gene contained in the genome of Vaccinia virus. VGAM297 host target gene, herein designated VGAM HOST TARGET GENE, is a human gene contained in the human genome.

VGAM297 gene, herein designated VGAM GENE, encodes a VGAM297 precursor RNA, herein designated VGAM PRECURSOR RNA. Similar to other miRNA genes, and unlike most ordinary genes, VGAM297 precursor RNA, herein designated VGAM PRECURSOR RNA, does not encode a protein. A nucleotide sequence identical or highly similar to the nucleotide sequence of VGAM297 precursor RNA is designated SEQ ID:283, and is provided hereinbelow with reference to the sequence listing part. Nucleotide sequence SEQ ID:283 is located at position 170506 relative to the genome of Vaccinia virus.

VGAM297 precursor RNA, herein designated VGAM PRECURSOR RNA, folds onto itself, forming VGAM297 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM297 folded precursor RNA, herein designated VGAM FOLDED PRECURSOR RNA, into VGAM297 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 77%) nucleotide sequence of VGAM297 RNA is designated SEQ ID:632, and is provided hereinbelow with reference to the sequence listing part.

VGAM297 host target gene, herein designated VGAM HOST TARGET GENE, encodes a corresponding messenger RNA, VGAM297 host target RNA, herein designated VGAM HOST TARGET RNA. VGAM297 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM297 RNA, herein designated VGAM RNA, binds complementarily to one or more host target binding sites located in untranslated regions of VGAM297 host target RNA, herein designated VGAM HOST TARGET RNA. This complementary binding is due to the fact that the nucleotide sequence of VGAM297 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM297 RNA, herein designated VGAM RNA, may have a different number of host target binding sites in untranslated regions of a VGAM297 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM297 RNA, herein designated VGAM RNA, to host target binding sites on VGAM297 host target RNA, herein designated VGAM HOST TARGET RNA, such as BINDING SITE I, BINDING SITE II and BINDING SITE III, inhibits translation of VGAM297 host target RNA, herein designated VGAM HOST TARGET RNA, into VGAM297 host target protein, herein designated VGAM HOST TARGET PROTEIN. VGAM host target protein is therefore outlined by a broken line.

It is appreciated that VGAM297 host target gene, herein designated VGAM HOST TARGET GENE, in fact represents a plurality of VGAM297 host target genes. The mRNA of each one of this plurality of VGAM297 host target genes comprises one or more host target binding sites, each having a nucleotide sequence which is at least partly complementary to VGAM297 RNA, herein designated VGAM RNA, and which when bound by VGAM297 RNA, herein designated VGAM RNA, causes inhibition of translation of respective one or more VGAM297 host target proteins.

It is further appreciated by one skilled in the art that the mode of translational inhibition illustrated by FIG. 1 with specific reference to translational inhibition exerted by VGAM297 gene, herein designated VGAM GENE, on one or more VGAM297 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM297 is inhibition of expression of host target genes, as part of a novel viral mechanism of attacking a host. Accordingly, utilities of VGAM297 include diagnosis, prevention and treatment of viral infection by Vaccinia virus. Specific functions, and accordingly utilities, of VGAM297 correlate with, and may be deduced from, the identity of the host target genes which VGAM297 binds and inhibits, and the function of these host target genes, as elaborated hereinbelow.

Nucleotide sequences of the VGAM297 precursor RNA, herein designated VGAM PRECURSOR RNA, and of the diced VGAM297 RNA, herein designated VGAM RNA, and a schematic representation of the secondary folding of VGAM297 folded precursor RNA, herein designated VGAM FOLDED PRECURSOR RNA, of VGAM297 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM297 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 298 (VGAM298) viral gene, which modulates expression of respective host target genes thereof, the function and utility of which host target genes is known in the art.

VGAM298 is a novel bioinformatically detected regulatory, non protein coding, viral micro RNA (miRNA) gene. The method by which VGAM298 was detected is described hereinabove with reference to FIGS. 2-8.

VGAM298 gene, herein designated VGAM GENE, is a viral gene contained in the genome of Vaccinia virus. VGAM298 host target gene, herein designated VGAM HOST TARGET GENE, is a human gene contained in the human genome.

VGAM298 gene, herein designated VGAM GENE, encodes a VGAM298 precursor RNA, herein designated VGAM PRECURSOR RNA. Similar to other miRNA genes, and unlike most ordinary genes, VGAM298 precursor RNA, herein designated VGAM PRECURSOR RNA, does not encode a protein. A nucleotide sequence identical or highly similar to the nucleotide sequence of VGAM298 precursor RNA is designated SEQ ID:284, and is provided hereinbelow with reference to the sequence listing part. Nucleotide sequence SEQ ID:284 is located at position 173577 relative to the genome of Vaccinia virus.

VGAM298 precursor RNA, herein designated VGAM PRECURSOR RNA, folds onto itself, forming VGAM298 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM298 folded precursor RNA, herein designated VGAM FOLDED PRECURSOR RNA, into VGAM298 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 79%) nucleotide sequence of VGAM298 RNA is designated SEQ ID:633, and is provided hereinbelow with reference to the sequence listing part.

VGAM298 host target gene, herein designated VGAM HOST TARGET GENE, encodes a corresponding messenger RNA, VGAM298 host target RNA, herein designated VGAM HOST TARGET RNA. VGAM298 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM298 RNA, herein designated VGAM RNA, binds complementarily to one or more host target binding sites located in untranslated regions of VGAM298 host target RNA, herein designated VGAM HOST TARGET RNA. This complementary binding is due to the fact that the nucleotide sequence of VGAM298 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM298 RNA, herein designated VGAM RNA, may have a different number of host target binding sites in untranslated regions of a VGAM298 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM298 RNA, herein designated VGAM RNA, to host target binding sites on VGAM298 host target RNA, herein designated VGAM HOST TARGET RNA, such as BINDING SITE I, BINDING SITE II and BINDING SITE III, inhibits translation of VGAM298 host target RNA, herein designated VGAM HOST TARGET RNA, into VGAM298 host target protein, herein designated VGAM HOST TARGET PROTEIN. VGAM host target protein is therefore outlined by a broken line.

It is appreciated that VGAM298 host target gene, herein designated VGAM HOST TARGET GENE, in fact represents a plurality of VGAM298 host target genes. The mRNA of each one of this plurality of VGAM298 host target genes comprises one or more host target binding sites, each having a nucleotide sequence which is at least partly complementary to VGAM298 RNA, herein designated VGAM RNA, and which when bound by VGAM298 RNA, herein designated VGAM RNA, causes inhibition of translation of respective one or more VGAM298 host target proteins.

It is further appreciated by one skilled in the art that the mode of translational inhibition illustrated by FIG. 1 with specific reference to translational inhibition exerted by VGAM298 gene, herein designated VGAM GENE, on one or more VGAM298 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM298 is inhibition of expression of host target genes, as part of a novel viral mechanism of attacking a host. Accordingly, utilities of VGAM298 include diagnosis, prevention and treatment of viral infection by Vaccinia virus. Specific functions, and accordingly utilities, of VGAM298 correlate with, and may be deduced from, the identity of the host target genes which VGAM298 binds and inhibits, and the function of these host target genes, as elaborated hereinbelow.

Nucleotide sequences of the VGAM298 precursor RNA, herein designated VGAM PRECURSOR RNA, and of the diced VGAM298 RNA, herein designated VGAM RNA, and a schematic representation of the secondary folding of VGAM298 folded precursor RNA, herein designated VGAM FOLDED PRECURSOR RNA, of VGAM298 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM298 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 299 (VGAM299) viral gene, which modulates expression of respective host target genes thereof, the function and utility of which host target genes is known in the art.

VGAM299 is a novel bioinformatically detected regulatory, non protein coding, viral micro RNA (miRNA) gene. The method by which VGAM299 was detected is described hereinabove with reference to FIGS. 2-8.

VGAM299 gene, herein designated VGAM GENE, is a viral gene contained in the genome of Vaccinia virus. VGAM299 host target gene, herein designated VGAM HOST TARGET GENE, is a human gene contained in the human genome.

VGAM299 gene, herein designated VGAM GENE, encodes a VGAM299 precursor RNA, herein designated VGAM PRECURSOR RNA. Similar to other miRNA genes, and unlike most ordinary genes, VGAM299 precursor RNA, herein designated VGAM PRECURSOR RNA, does not encode a protein. A nucleotide sequence identical or highly similar to the nucleotide sequence of VGAM299 precursor RNA is designated SEQ ID:285, and is provided hereinbelow with reference to the sequence listing part. Nucleotide sequence SEQ ID:285 is located at position 168765 relative to the genome of Vaccinia virus.

VGAM299 precursor RNA, herein designated VGAM PRECURSOR RNA, folds onto itself, forming VGAM299 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM299 folded precursor RNA, herein designated VGAM FOLDED PRECURSOR RNA, into VGAM299 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 25%) nucleotide sequence of VGAM299 RNA is designated SEQ ID:634, and is provided hereinbelow with reference to the sequence listing part.

VGAM299 host target gene, herein designated VGAM HOST TARGET GENE, encodes a corresponding messenger RNA, VGAM299 host target RNA, herein designated VGAM HOST TARGET RNA. VGAM299 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM299 RNA, herein designated VGAM RNA, binds complementarily to one or more host target binding sites located in untranslated regions of VGAM299 host target RNA, herein designated VGAM HOST TARGET RNA. This complementary binding is due to the fact that the nucleotide sequence of VGAM299 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM299 RNA, herein designated VGAM RNA, may have a different number of host target binding sites in untranslated regions of a VGAM299 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM299 RNA, herein designated VGAM RNA, to host target binding sites on VGAM299 host target RNA, herein designated VGAM HOST TARGET RNA, such as BINDING SITE I, BINDING SITE II and BINDING SITE III, inhibits translation of VGAM299 host target RNA, herein designated VGAM HOST TARGET RNA, into VGAM299 host target protein, herein designated VGAM HOST TARGET PROTEIN. VGAM host target protein is therefore outlined by a broken line.

It is appreciated that VGAM299 host target gene, herein designated VGAM HOST TARGET GENE, in fact represents a plurality of VGAM299 host target genes. The mRNA of each one of this plurality of VGAM299 host target genes comprises one or more host target binding sites, each having a nucleotide sequence which is at least partly complementary to VGAM299 RNA, herein designated VGAM RNA, and which when bound by VGAM299 RNA, herein designated VGAM RNA, causes inhibition of translation of respective one or more VGAM299 host target proteins.

It is further appreciated by one skilled in the art that the mode of translational inhibition illustrated by FIG. 1 with specific reference to translational inhibition exerted by VGAM299 gene, herein designated VGAM GENE, on one or more VGAM299 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM299 is inhibition of expression of host target genes, as part of a novel viral mechanism of attacking a host. Accordingly, utilities of VGAM299 include diagnosis, prevention and treatment of viral infection by Vaccinia virus. Specific functions, and accordingly utilities, of VGAM299 correlate with, and may be deduced from, the identity of the host target genes which VGAM299 binds and inhibits, and the function of these host target genes, as elaborated hereinbelow.

Nucleotide sequences of the VGAM299 precursor RNA, herein designated VGAM PRECURSOR RNA, and of the diced VGAM299 RNA, herein designated VGAM RNA, and a schematic representation of the secondary folding of VGAM299 folded precursor RNA, herein designated VGAM FOLDED PRECURSOR RNA, of VGAM299 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM299 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 300 (VGAM300) viral gene, which modulates expression of respective host target genes thereof, the function and utility of which host target genes is known in the art.

VGAM300 is a novel bioinformatically detected regulatory, non protein coding, viral micro RNA (miRNA) gene. The method by which VGAM300 was detected is described hereinabove with reference to FIGS. 2-8.

VGAM300 gene, herein designated VGAM GENE, is a viral gene contained in the genome of Vaccinia virus. VGAM300 host target gene, herein designated VGAM HOST TARGET GENE, is a human gene contained in the human genome.

VGAM300 gene, herein designated VGAM GENE, encodes a VGAM300 precursor RNA, herein designated VGAM PRECURSOR RNA. Similar to other miRNA genes, and unlike most ordinary genes, VGAM300 precursor RNA, herein designated VGAM PRECURSOR RNA, does not encode a protein. A nucleotide sequence identical or highly similar to the nucleotide sequence of VGAM300 precursor RNA is designated SEQ ID:286, and is provided hereinbelow with reference to the sequence listing part. Nucleotide sequence SEQ ID:286 is located at position 172477 relative to the genome of Vaccinia virus.

VGAM300 precursor RNA, herein designated VGAM PRECURSOR RNA, folds onto itself, forming VGAM300 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM300 folded precursor RNA, herein designated VGAM FOLDED PRECURSOR RNA, into VGAM300 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM300 RNA is designated SEQ ID:635, and is provided hereinbelow with reference to the sequence listing part.

VGAM300 host target gene, herein designated VGAM HOST TARGET GENE, encodes a corresponding messenger RNA, VGAM300 host target RNA, herein designated VGAM HOST TARGET RNA. VGAM300 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM300 RNA, herein designated VGAM RNA, binds complementarily to one or more host target binding sites located in untranslated regions of VGAM300 host target RNA, herein designated VGAM HOST TARGET RNA. This complementary binding is due to the fact that the nucleotide sequence of VGAM300 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM300 RNA, herein designated VGAM RNA, may have a different number of host target binding sites in untranslated regions of a VGAM300 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM300 RNA, herein designated VGAM RNA, to host target binding sites on VGAM300 host target RNA, herein designated VGAM HOST TARGET RNA, such as BINDING SITE I, BINDING SITE II and BINDING SITE III, inhibits translation of VGAM300 host target RNA, herein designated VGAM HOST TARGET RNA, into VGAM300 host target protein, herein designated VGAM HOST TARGET PROTEIN. VGAM host target protein is therefore outlined by a broken line.

It is appreciated that VGAM300 host target gene, herein designated VGAM HOST TARGET GENE, in fact represents a plurality of VGAM300 host target genes. The mRNA of each one of this plurality of VGAM300 host target genes comprises one or more host target binding sites, each having a nucleotide sequence which is at least partly complementary to VGAM300 RNA, herein designated VGAM RNA, and which when bound by VGAM300 RNA, herein designated VGAM RNA, causes inhibition of translation of respective one or more VGAM300 host target proteins.

It is further appreciated by one skilled in the art that the mode of translational inhibition illustrated by FIG. 1 with specific reference to translational inhibition exerted by VGAM300 gene, herein designated VGAM GENE, on one or more VGAM300 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM300 is inhibition of expression of host target genes, as part of a novel viral mechanism of attacking a host. Accordingly, utilities of VGAM300 include diagnosis, prevention and treatment of viral infection by Vaccinia virus. Specific functions, and accordingly utilities, of VGAM300 correlate with, and may be deduced from, the identity of the host target genes which VGAM300 binds and inhibits, and the function of these host target genes, as elaborated hereinbelow.

Nucleotide sequences of the VGAM300 precursor RNA, herein designated VGAM PRECURSOR RNA, and of the diced VGAM300 RNA, herein designated VGAM RNA, and a schematic representation of the secondary folding of VGAM300 folded precursor RNA, herein designated VGAM FOLDED PRECURSOR RNA, of VGAM300 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM300 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 301 (VGAM301) viral gene, which modulates expression of respective host target genes thereof, the function and utility of which host target genes is known in the art.

VGAM301 is a novel bioinformatically detected regulatory, non protein coding, viral micro RNA (miRNA) gene. The method by which VGAM301 was detected is described hereinabove with reference to FIGS. 2-8.

VGAM301 gene, herein designated VGAM GENE, is a viral gene contained in the genome of Vaccinia virus. VGAM301 host target gene, herein designated VGAM HOST TARGET GENE, is a human gene contained in the human genome.

VGAM301 gene, herein designated VGAM GENE, encodes a VGAM301 precursor RNA, herein designated VGAM PRECURSOR RNA. Similar to other miRNA genes, and unlike most ordinary genes, VGAM301 precursor RNA, herein designated VGAM PRECURSOR RNA, does not encode a protein. A nucleotide sequence identical or highly similar to the nucleotide sequence of VGAM301 precursor RNA is designated SEQ ID:287, and is provided hereinbelow with reference to the sequence listing part. Nucleotide sequence SEQ ID:287 is located at position 174245 relative to the genome of Vaccinia virus.

VGAM301 precursor RNA, herein designated VGAM PRECURSOR RNA, folds onto itself, forming VGAM301 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM301 folded precursor RNA, herein designated VGAM FOLDED PRECURSOR RNA, into VGAM301 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 72%) nucleotide sequence of VGAM301 RNA is designated SEQ ID:636, and is provided hereinbelow with reference to the sequence listing part.

VGAM301 host target gene, herein designated VGAM HOST TARGET GENE, encodes a corresponding messenger RNA, VGAM301 host target RNA, herein designated VGAM HOST TARGET RNA. VGAM301 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM301 RNA, herein designated VGAM RNA, binds complementarily to one or more host target binding sites located in untranslated regions of VGAM301 host target RNA, herein designated VGAM HOST TARGET RNA. This complementary binding is due to the fact that the nucleotide sequence of VGAM301 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM301 RNA, herein designated VGAM RNA, may have a different number of host target binding sites in untranslated regions of a VGAM301 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM301 RNA, herein designated VGAM RNA, to host target binding sites on VGAM301 host target RNA, herein designated VGAM HOST TARGET RNA, such as BINDING SITE I, BINDING SITE II and BINDING SITE III, inhibits translation of VGAM301 host target RNA, herein designated VGAM HOST TARGET RNA, into VGAM301 host target protein, herein designated VGAM HOST TARGET PROTEIN. VGAM host target protein is therefore outlined by a broken line.

It is appreciated that VGAM301 host target gene, herein designated VGAM HOST TARGET GENE, in fact represents a plurality of VGAM301 host target genes. The mRNA of each one of this plurality of VGAM301 host target genes comprises one or more host target binding sites, each having a nucleotide sequence which is at least partly complementary to VGAM301 RNA, herein designated VGAM RNA, and which when bound by VGAM301 RNA, herein designated VGAM RNA, causes inhibition of translation of respective one or more VGAM301 host target proteins.

It is further appreciated by one skilled in the art that the mode of translational inhibition illustrated by FIG. 1 with specific reference to translational inhibition exerted by VGAM301 gene, herein designated VGAM GENE, on one or more VGAM301 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM301 is inhibition of expression of host target genes, as part of a novel viral mechanism of attacking a host. Accordingly, utilities of VGAM301 include diagnosis, prevention and treatment of viral infection by Vaccinia virus. Specific functions, and accordingly utilities, of VGAM301 correlate with, and may be deduced from, the identity of the host target genes which VGAM301 binds and inhibits, and the function of these host target genes, as elaborated hereinbelow.

Nucleotide sequences of the VGAM301 precursor RNA, herein designated VGAM PRECURSOR RNA, and of the diced VGAM301 RNA, herein designated VGAM RNA, and a schematic representation of the secondary folding of VGAM301 folded precursor RNA, herein designated VGAM FOLDED PRECURSOR RNA, of VGAM301 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM301 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 302 (VGAM302) viral gene, which modulates expression of respective host target genes thereof, the function and utility of which host target genes is known in the art.

VGAM302 is a novel bioinformatically detected regulatory, non protein coding, viral micro RNA (miRNA) gene. The method by which VGAM302 was detected is described hereinabove with reference to FIGS. 2-8.

VGAM302 gene, herein designated VGAM GENE, is a viral gene contained in the genome of Vaccinia virus. VGAM302 host target gene, herein designated VGAM HOST TARGET GENE, is a human gene contained in the human genome.

VGAM302 gene, herein designated VGAM GENE, encodes a VGAM302 precursor RNA, herein designated VGAM PRECURSOR RNA. Similar to other miRNA genes, and unlike most ordinary genes, VGAM302 precursor RNA, herein designated VGAM PRECURSOR RNA, does not encode a protein. A nucleotide sequence identical or highly similar to the nucleotide sequence of VGAM302 precursor RNA is designated SEQ ID:288, and is provided hereinbelow with reference to the sequence listing part. Nucleotide sequence SEQ ID:288 is located at position 175500 relative to the genome of Vaccinia virus.

VGAM302 precursor RNA, herein designated VGAM PRECURSOR RNA, folds onto itself, forming VGAM302 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM302 folded precursor RNA, herein designated VGAM FOLDED PRECURSOR RNA, into VGAM302 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 74%) nucleotide sequence of VGAM302 RNA is designated SEQ ID:637, and is provided hereinbelow with reference to the sequence listing part.

VGAM302 host target gene, herein designated VGAM HOST TARGET GENE, encodes a corresponding messenger RNA, VGAM302 host target RNA, herein designated VGAM HOST TARGET RNA. VGAM302 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM302 RNA, herein designated VGAM RNA, binds complementarily to one or more host target binding sites located in untranslated regions of VGAM302 host target RNA, herein designated VGAM HOST TARGET RNA. This complementary binding is due to the fact that the nucleotide sequence of VGAM302 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM302 RNA, herein designated VGAM RNA, may have a different number of host target binding sites in untranslated regions of a VGAM302 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM302 RNA, herein designated VGAM RNA, to host target binding sites on VGAM302 host target RNA, herein designated VGAM HOST TARGET RNA, such as BINDING SITE I, BINDING SITE II and BINDING SITE III, inhibits translation of VGAM302 host target RNA, herein designated VGAM HOST TARGET RNA, into VGAM302 host target protein, herein designated VGAM HOST TARGET PROTEIN. VGAM host target protein is therefore outlined by a broken line.

It is appreciated that VGAM302 host target gene, herein designated VGAM HOST TARGET GENE, in fact represents a plurality of VGAM302 host target genes. The mRNA of each one of this plurality of VGAM302 host target genes comprises one or more host target binding sites, each having a nucleotide sequence which is at least partly complementary to VGAM302 RNA, herein designated VGAM RNA, and which when bound by VGAM302 RNA, herein designated VGAM RNA, causes inhibition of translation of respective one or more VGAM302 host target proteins.

It is further appreciated by one skilled in the art that the mode of translational inhibition illustrated by FIG. 1 with specific reference to translational inhibition exerted by VGAM302 gene, herein designated VGAM GENE, on one or more VGAM302 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM302 is inhibition of expression of host target genes, as part of a novel viral mechanism of attacking a host. Accordingly, utilities of VGAM302 include diagnosis, prevention and treatment of viral infection by Vaccinia virus. Specific functions, and accordingly utilities, of VGAM302 correlate with, and may be deduced from, the identity of the host target genes which VGAM302 binds and inhibits, and the function of these host target genes, as elaborated hereinbelow.

Nucleotide sequences of the VGAM302 precursor RNA, herein designated VGAM PRECURSOR RNA, and of the diced VGAM302 RNA, herein designated VGAM RNA, and a schematic representation of the secondary folding of VGAM302 folded precursor RNA, herein designated VGAM FOLDED PRECURSOR RNA, of VGAM302 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM302 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 303 (VGAM303) viral gene, which modulates expression of respective host target genes thereof, the function and utility of which host target genes is known in the art.

VGAM303 is a novel bioinformatically detected regulatory, non protein coding, viral micro RNA (miRNA) gene. The method by which VGAM303 was detected is described hereinabove with reference to FIGS. 2-8.

VGAM303 gene, herein designated VGAM GENE, is a viral gene contained in the genome of Vaccinia virus. VGAM303 host target gene, herein designated VGAM HOST TARGET GENE, is a human gene contained in the human genome.

VGAM303 gene, herein designated VGAM GENE, encodes a VGAM303 precursor RNA, herein designated VGAM PRECURSOR RNA. Similar to other miRNA genes, and unlike most ordinary genes, VGAM303 precursor RNA, herein designated VGAM PRECURSOR RNA, does not encode a protein. A nucleotide sequence identical or highly similar to the nucleotide sequence of VGAM303 precursor RNA is designated SEQ ID:289, and is provided hereinbelow with reference to the sequence listing part. Nucleotide sequence SEQ ID:289 is located at position 9636 relative to the genome of Vaccinia virus.

VGAM303 precursor RNA, herein designated VGAM PRECURSOR RNA, folds onto itself, forming VGAM303 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM303 folded precursor RNA, herein designated VGAM FOLDED PRECURSOR RNA, into VGAM303 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 71%) nucleotide sequence of VGAM303 RNA is designated SEQ ID:638, and is provided hereinbelow with reference to the sequence listing part.

VGAM303 host target gene, herein designated VGAM HOST TARGET GENE, encodes a corresponding messenger RNA, VGAM303 host target RNA, herein designated VGAM HOST TARGET RNA. VGAM303 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM303 RNA, herein designated VGAM RNA, binds complementarily to one or more host target binding sites located in untranslated regions of VGAM303 host target RNA, herein designated VGAM HOST TARGET RNA. This complementary binding is due to the fact that the nucleotide sequence of VGAM303 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM303 RNA, herein designated VGAM RNA, may have a different number of host target binding sites in untranslated regions of a VGAM303 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM303 RNA, herein designated VGAM RNA, to host target binding sites on VGAM303 host target RNA, herein designated VGAM HOST TARGET RNA, such as BINDING SITE I, BINDING SITE II and BINDING SITE III, inhibits translation of VGAM303 host target RNA, herein designated VGAM HOST TARGET RNA, into VGAM303 host target protein, herein designated VGAM HOST TARGET PROTEIN. VGAM host target protein is therefore outlined by a broken line.

It is appreciated that VGAM303 host target gene, herein designated VGAM HOST TARGET GENE, in fact represents a plurality of VGAM303 host target genes. The mRNA of each one of this plurality of VGAM303 host target genes comprises one or more host target binding sites, each having a nucleotide sequence which is at least partly complementary to VGAM303 RNA, herein designated VGAM RNA, and which when bound by VGAM303 RNA, herein designated VGAM RNA, causes inhibition of translation of respective one or more VGAM303 host target proteins.

It is further appreciated by one skilled in the art that the mode of translational inhibition illustrated by FIG. 1 with specific reference to translational inhibition exerted by VGAM303 gene, herein designated VGAM GENE, on one or more VGAM303 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM303 is inhibition of expression of host target genes, as part of a novel viral mechanism of attacking a host. Accordingly, utilities of VGAM303 include diagnosis, prevention and treatment of viral infection by Vaccinia virus. Specific functions, and accordingly utilities, of VGAM303 correlate with, and may be deduced from, the identity of the host target genes which VGAM303 binds and inhibits, and the function of these host target genes, as elaborated hereinbelow.

Nucleotide sequences of the VGAM303 precursor RNA, herein designated VGAM PRECURSOR RNA, and of the diced VGAM303 RNA, herein designated VGAM RNA, and a schematic representation of the secondary folding of VGAM303 folded precursor RNA, herein designated VGAM FOLDED PRECURSOR RNA, of VGAM303 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM303 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 304 (VGAM304) viral gene, which modulates expression of respective host target genes thereof, the function and utility of which host target genes is known in the art.

VGAM304 is a novel bioinformatically detected regulatory, non protein coding, viral micro RNA (miRNA) gene. The method by which VGAM304 was detected is described hereinabove with reference to FIGS. 2-8.

VGAM304 gene, herein designated VGAM GENE, is a viral gene contained in the genome of Vaccinia virus. VGAM304 host target gene, herein designated VGAM HOST TARGET GENE, is a human gene contained in the human genome.

VGAM304 gene, herein designated VGAM GENE, encodes a VGAM304 precursor RNA, herein designated VGAM PRECURSOR RNA. Similar to other miRNA genes, and unlike most ordinary genes, VGAM304 precursor RNA, herein designated VGAM PRECURSOR RNA, does not encode a protein. A nucleotide sequence identical or highly similar to the nucleotide sequence of VGAM304 precursor RNA is designated SEQ ID:290, and is provided hereinbelow with reference to the sequence listing part. Nucleotide sequence SEQ ID:290 is located at position 179183 relative to the genome of Vaccinia virus.

VGAM304 precursor RNA, herein designated VGAM PRECURSOR RNA, folds onto itself, forming VGAM304 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM304 folded precursor RNA, herein designated VGAM FOLDED PRECURSOR RNA, into VGAM304 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 87%) nucleotide sequence of VGAM304 RNA is designated SEQ ID:639, and is provided hereinbelow with reference to the sequence listing part.

VGAM304 host target gene, herein designated VGAM HOST TARGET GENE, encodes a corresponding messenger RNA, VGAM304 host target RNA, herein designated VGAM HOST TARGET RNA. VGAM304 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM304 RNA, herein designated VGAM RNA, binds complementarily to one or more host target binding sites located in untranslated regions of VGAM304 host target RNA, herein designated VGAM HOST TARGET RNA. This complementary binding is due to the fact that the nucleotide sequence of VGAM304 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM304 RNA, herein designated VGAM RNA, may have a different number of host target binding sites in untranslated regions of a VGAM304 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM304 RNA, herein designated VGAM RNA, to host target binding sites on VGAM304 host target RNA, herein designated VGAM HOST TARGET RNA, such as BINDING SITE I, BINDING SITE II and BINDING SITE III, inhibits translation of VGAM304 host target RNA, herein designated VGAM HOST TARGET RNA, into VGAM304 host target protein, herein designated VGAM HOST TARGET PROTEIN. VGAM host target protein is therefore outlined by a broken line.

It is appreciated that VGAM304 host target gene, herein designated VGAM HOST TARGET GENE, in fact represents a plurality of VGAM304 host target genes. The mRNA of each one of this plurality of VGAM304 host target genes comprises one or more host target binding sites, each having a nucleotide sequence which is at least partly complementary to VGAM304 RNA, herein designated VGAM RNA, and which when bound by VGAM304 RNA, herein designated VGAM RNA, causes inhibition of translation of respective one or more VGAM304 host target proteins.

It is further appreciated by one skilled in the art that the mode of translational inhibition illustrated by FIG. 1 with specific reference to translational inhibition exerted by VGAM304 gene, herein designated VGAM GENE, on one or more VGAM304 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM304 is inhibition of expression of host target genes, as part of a novel viral mechanism of attacking a host. Accordingly, utilities of VGAM304 include diagnosis, prevention and treatment of viral infection by Vaccinia virus. Specific functions, and accordingly utilities, of VGAM304 correlate with, and may be deduced from, the identity of the host target genes which VGAM304 binds and inhibits, and the function of these host target genes, as elaborated hereinbelow.

Nucleotide sequences of the VGAM304 precursor RNA, herein designated VGAM PRECURSOR RNA, and of the diced VGAM304 RNA, herein designated VGAM RNA, and a schematic representation of the secondary folding of VGAM304 folded precursor RNA, herein designated VGAM FOLDED PRECURSOR RNA, of VGAM304 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM304 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 305 (VGAM305) viral gene, which modulates expression of respective host target genes thereof, the function and utility of which host target genes is known in the art.

VGAM305 is a novel bioinformatically detected regulatory, non protein coding, viral micro RNA (miRNA) gene. The method by which VGAM305 was detected is described hereinabove with reference to FIGS. 2-8.

VGAM305 gene, herein designated VGAM GENE, is a viral gene contained in the genome of Vaccinia virus. VGAM305 host target gene, herein designated VGAM HOST TARGET GENE, is a human gene contained in the human genome.

VGAM305 gene, herein designated VGAM GENE, encodes a VGAM305 precursor RNA, herein designated VGAM PRECURSOR RNA. Similar to other miRNA genes, and unlike most ordinary genes, VGAM305 precursor RNA, herein designated VGAM PRECURSOR RNA, does not encode a protein. A nucleotide sequence identical or highly similar to the nucleotide sequence of VGAM305 precursor RNA is designated SEQ ID:291, and is provided hereinbelow with reference to the sequence listing part. Nucleotide sequence SEQ ID:291 is located at position 179295 relative to the genome of Vaccinia virus.

VGAM305 precursor RNA, herein designated VGAM PRECURSOR RNA, folds onto itself, forming VGAM305 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM305 folded precursor RNA, herein designated VGAM FOLDED PRECURSOR RNA, into VGAM305 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM305 RNA is designated SEQ ID:640, and is provided hereinbelow with reference to the sequence listing part.

VGAM305 host target gene, herein designated VGAM HOST TARGET GENE, encodes a corresponding messenger RNA, VGAM305 host target RNA, herein designated VGAM HOST TARGET RNA. VGAM305 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM305 RNA, herein designated VGAM RNA, binds complementarily to one or more host target binding sites located in untranslated regions of VGAM305 host target RNA, herein designated VGAM HOST TARGET RNA. This complementary binding is due to the fact that the nucleotide sequence of VGAM305 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM305 RNA, herein designated VGAM RNA, may have a different number of host target binding sites in untranslated regions of a VGAM305 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM305 RNA, herein designated VGAM RNA, to host target binding sites on VGAM305 host target RNA, herein designated VGAM HOST TARGET RNA, such as BINDING SITE I, BINDING SITE II and BINDING SITE III, inhibits translation of VGAM305 host target RNA, herein designated VGAM HOST TARGET RNA, into VGAM305 host target protein, herein designated VGAM HOST TARGET PROTEIN. VGAM host target protein is therefore outlined by a broken line.

It is appreciated that VGAM305 host target gene, herein designated VGAM HOST TARGET GENE, in fact represents a plurality of VGAM305 host target genes. The mRNA of each one of this plurality of VGAM305 host target genes comprises one or more host target binding sites, each having a nucleotide sequence which is at least partly complementary to VGAM305 RNA, herein designated VGAM RNA, and which when bound by VGAM305 RNA, herein designated VGAM RNA, causes inhibition of translation of respective one or more VGAM305 host target proteins.

It is further appreciated by one skilled in the art that the mode of translational inhibition illustrated by FIG. 1 with specific reference to translational inhibition exerted by VGAM305 gene, herein designated VGAM GENE, on one or more VGAM305 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM305 is inhibition of expression of host target genes, as part of a novel viral mechanism of attacking a host. Accordingly, utilities of VGAM305 include diagnosis, prevention and treatment of viral infection by Vaccinia virus. Specific functions, and accordingly utilities, of VGAM305 correlate with, and may be deduced from, the identity of the host target genes which VGAM305 binds and inhibits, and the function of these host target genes, as elaborated hereinbelow.

Nucleotide sequences of the VGAM305 precursor RNA, herein designated VGAM PRECURSOR RNA, and of the diced VGAM305 RNA, herein designated VGAM RNA, and a schematic representation of the secondary folding of VGAM305 folded precursor RNA, herein designated VGAM FOLDED PRECURSOR RNA, of VGAM305 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM305 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 306 (VGAM306) viral gene, which modulates expression of respective host target genes thereof, the function and utility of which host target genes is known in the art.

VGAM306 is a novel bioinformatically detected regulatory, non protein coding, viral micro RNA (miRNA) gene. The method by which VGAM306 was detected is described hereinabove with reference to FIGS. 2-8.

VGAM306 gene, herein designated VGAM GENE, is a viral gene contained in the genome of Vaccinia virus. VGAM306 host target gene, herein designated VGAM HOST TARGET GENE, is a human gene contained in the human genome.

VGAM306 gene, herein designated VGAM GENE, encodes a VGAM306 precursor RNA, herein designated VGAM PRECURSOR RNA. Similar to other miRNA genes, and unlike most ordinary genes, VGAM306 precursor RNA, herein designated VGAM PRECURSOR RNA, does not encode a protein. A nucleotide sequence identical or highly similar to the nucleotide sequence of VGAM306 precursor RNA is designated SEQ ID:292, and is provided hereinbelow with reference to the sequence listing part. Nucleotide sequence SEQ ID:292 is located at position 176521 relative to the genome of Vaccinia virus.

VGAM306 precursor RNA, herein designated VGAM PRECURSOR RNA, folds onto itself, forming VGAM306 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM306 folded precursor RNA, herein designated VGAM FOLDED PRECURSOR RNA, into VGAM306 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 73%) nucleotide sequence of VGAM306 RNA is designated SEQ ID:641, and is provided hereinbelow with reference to the sequence listing part.

VGAM306 host target gene, herein designated VGAM HOST TARGET GENE, encodes a corresponding messenger RNA, VGAM306 host target RNA, herein designated VGAM HOST TARGET RNA. VGAM306 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM306 RNA, herein designated VGAM RNA, binds complementarily to one or more host target binding sites located in untranslated regions of VGAM306 host target RNA, herein designated VGAM HOST TARGET RNA. This complementary binding is due to the fact that the nucleotide sequence of VGAM306 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM306 RNA, herein designated VGAM RNA, may have a different number of host target binding sites in untranslated regions of a VGAM306 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM306 RNA, herein designated VGAM RNA, to host target binding sites on VGAM306 host target RNA, herein designated VGAM HOST TARGET RNA, such as BINDING SITE I, BINDING SITE II and BINDING SITE III, inhibits translation of VGAM306 host target RNA, herein designated VGAM HOST TARGET RNA, into VGAM306 host target protein, herein designated VGAM HOST TARGET PROTEIN. VGAM host target protein is therefore outlined by a broken line.

It is appreciated that VGAM306 host target gene, herein designated VGAM HOST TARGET GENE, in fact represents a plurality of VGAM306 host target genes. The mRNA of each one of this plurality of VGAM306 host target genes comprises one or more host target binding sites, each having a nucleotide sequence which is at least partly complementary to VGAM306 RNA, herein designated VGAM RNA, and which when bound by VGAM306 RNA, herein designated VGAM RNA, causes inhibition of translation of respective one or more VGAM306 host target proteins.

It is further appreciated by one skilled in the art that the mode of translational inhibition illustrated by FIG. 1 with specific reference to translational inhibition exerted by VGAM306 gene, herein designated VGAM GENE, on one or more VGAM306 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM306 is inhibition of expression of host target genes, as part of a novel viral mechanism of attacking a host. Accordingly, utilities of VGAM306 include diagnosis, prevention and treatment of viral infection by Vaccinia virus. Specific functions, and accordingly utilities, of VGAM306 correlate with, and may be deduced from, the identity of the host target genes which VGAM306 binds and inhibits, and the function of these host target genes, as elaborated hereinbelow.

Nucleotide sequences of the VGAM306 precursor RNA, herein designated VGAM PRECURSOR RNA, and of the diced VGAM306 RNA, herein designated VGAM RNA, and a schematic representation of the secondary folding of VGAM306 folded precursor RNA, herein designated VGAM FOLDED PRECURSOR RNA, of VGAM306 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM306 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 307 (VGAM307) viral gene, which modulates expression of respective host target genes thereof, the function and utility of which host target genes is known in the art.

VGAM307 is a novel bioinformatically detected regulatory, non protein coding, viral micro RNA (miRNA) gene. The method by which VGAM307 was detected is described hereinabove with reference to FIGS. 2-8.

VGAM307 gene, herein designated VGAM GENE, is a viral gene contained in the genome of Vaccinia virus. VGAM307 host target gene, herein designated VGAM HOST TARGET GENE, is a human gene contained in the human genome.

VGAM307 gene, herein designated VGAM GENE, encodes a VGAM307 precursor RNA, herein designated VGAM PRECURSOR RNA. Similar to other miRNA genes, and unlike most ordinary genes, VGAM307 precursor RNA, herein designated VGAM PRECURSOR RNA, does not encode a protein. A nucleotide sequence identical or highly similar to the nucleotide sequence of VGAM307 precursor RNA is designated SEQ ID:293, and is provided hereinbelow with reference to the sequence listing part. Nucleotide sequence SEQ ID:293 is located at position 10139 relative to the genome of Vaccinia virus.

VGAM307 precursor RNA, herein designated VGAM PRECURSOR RNA, folds onto itself, forming VGAM307 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM307 folded precursor RNA, herein designated VGAM FOLDED PRECURSOR RNA, into VGAM307 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 87%) nucleotide sequence of VGAM307 RNA is designated SEQ ID:642, and is provided hereinbelow with reference to the sequence listing part.

VGAM307 host target gene, herein designated VGAM HOST TARGET GENE, encodes a corresponding messenger RNA, VGAM307 host target RNA, herein designated VGAM HOST TARGET RNA. VGAM307 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM307 RNA, herein designated VGAM RNA, binds complementarily to one or more host target binding sites located in untranslated regions of VGAM307 host target RNA, herein designated VGAM HOST TARGET RNA. This complementary binding is due to the fact that the nucleotide sequence of VGAM307 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM307 RNA, herein designated VGAM RNA, may have a different number of host target binding sites in untranslated regions of a VGAM307 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM307 RNA, herein designated VGAM RNA, to host target binding sites on VGAM307 host target RNA, herein designated VGAM HOST TARGET RNA, such as BINDING SITE I, BINDING SITE II and BINDING SITE III, inhibits translation of VGAM307 host target RNA, herein designated VGAM HOST TARGET RNA, into VGAM307 host target protein, herein designated VGAM HOST TARGET PROTEIN. VGAM host target protein is therefore outlined by a broken line.

It is appreciated that VGAM307 host target gene, herein designated VGAM HOST TARGET GENE, in fact represents a plurality of VGAM307 host target genes. The mRNA of each one of this plurality of VGAM307 host target genes comprises one or more host target binding sites, each having a nucleotide sequence which is at least partly complementary to VGAM307 RNA, herein designated VGAM RNA, and which when bound by VGAM307 RNA, herein designated VGAM RNA, causes inhibition of translation of respective one or more VGAM307 host target proteins.

It is further appreciated by one skilled in the art that the mode of translational inhibition illustrated by FIG. 1 with specific reference to translational inhibition exerted by VGAM307 gene, herein designated VGAM GENE, on one or more VGAM307 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM307 is inhibition of expression of host target genes, as part of a novel viral mechanism of attacking a host. Accordingly, utilities of VGAM307 include diagnosis, prevention and treatment of viral infection by Vaccinia virus. Specific functions, and accordingly utilities, of VGAM307 correlate with, and may be deduced from, the identity of the host target genes which VGAM307 binds and inhibits, and the function of these host target genes, as elaborated hereinbelow.

Nucleotide sequences of the VGAM307 precursor RNA, herein designated VGAM PRECURSOR RNA, and of the diced VGAM307 RNA, herein designated VGAM RNA, and a schematic representation of the secondary folding of VGAM307 folded precursor RNA, herein designated VGAM FOLDED PRECURSOR RNA, of VGAM307 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM307 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 308 (VGAM308) viral gene, which modulates expression of respective host target genes thereof, the function and utility of which host target genes is known in the art.

VGAM308 is a novel bioinformatically detected regulatory, non protein coding, viral micro RNA (miRNA) gene. The method by which VGAM308 was detected is described hereinabove with reference to FIGS. 2-8.

VGAM308 gene, herein designated VGAM GENE, is a viral gene contained in the genome of Vaccinia virus. VGAM308 host target gene, herein designated VGAM HOST TARGET GENE, is a human gene contained in the human genome.

VGAM308 gene, herein designated VGAM GENE, encodes a VGAM308 precursor RNA, herein designated VGAM PRECURSOR RNA. Similar to other miRNA genes, and unlike most ordinary genes, VGAM308 precursor RNA, herein designated VGAM PRECURSOR RNA, does not encode a protein. A nucleotide sequence identical or highly similar to the nucleotide sequence of VGAM308 precursor RNA is designated SEQ ID:294, and is provided hereinbelow with reference to the sequence listing part. Nucleotide sequence SEQ ID:294 is located at position 9119 relative to the genome of Vaccinia virus.

VGAM308 precursor RNA, herein designated VGAM PRECURSOR RNA, folds onto itself, forming VGAM308 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM308 folded precursor RNA, herein designated VGAM FOLDED PRECURSOR RNA, into VGAM308 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM308 RNA is designated SEQ ID:643, and is provided hereinbelow with reference to the sequence listing part.

VGAM308 host target gene, herein designated VGAM HOST TARGET GENE, encodes a corresponding messenger RNA, VGAM308 host target RNA, herein designated VGAM HOST TARGET RNA. VGAM308 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM308 RNA, herein designated VGAM RNA, binds complementarily to one or more host target binding sites located in untranslated regions of VGAM308 host target RNA, herein designated VGAM HOST TARGET RNA. This complementary binding is due to the fact that the nucleotide sequence of VGAM308 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM308 RNA, herein designated VGAM RNA, may have a different number of host target binding sites in untranslated regions of a VGAM308 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM308 RNA, herein designated VGAM RNA, to host target binding sites on VGAM308 host target RNA, herein designated VGAM HOST TARGET RNA, such as BINDING SITE I, BINDING SITE II and BINDING SITE III, inhibits translation of VGAM308 host target RNA, herein designated VGAM HOST TARGET RNA, into VGAM308 host target protein, herein designated VGAM HOST TARGET PROTEIN. VGAM host target protein is therefore outlined by a broken line.

It is appreciated that VGAM308 host target gene, herein designated VGAM HOST TARGET GENE, in fact represents a plurality of VGAM308 host target genes. The mRNA of each one of this plurality of VGAM308 host target genes comprises one or more host target binding sites, each having a nucleotide sequence which is at least partly complementary to VGAM308 RNA, herein designated VGAM RNA, and which when bound by VGAM308 RNA, herein designated VGAM RNA, causes inhibition of translation of respective one or more VGAM308 host target proteins.

It is further appreciated by one skilled in the art that the mode of translational inhibition illustrated by FIG. 1 with specific reference to translational inhibition exerted by VGAM308 gene, herein designated VGAM GENE, on one or more VGAM308 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM308 is inhibition of expression of host target genes, as part of a novel viral mechanism of attacking a host. Accordingly, utilities of VGAM308 include diagnosis, prevention and treatment of viral infection by Vaccinia virus. Specific functions, and accordingly utilities, of VGAM308 correlate with, and may be deduced from, the identity of the host target genes which VGAM308 binds and inhibits, and the function of these host target genes, as elaborated hereinbelow.

Nucleotide sequences of the VGAM308 precursor RNA, herein designated VGAM PRECURSOR RNA, and of the diced VGAM308 RNA, herein designated VGAM RNA, and a schematic representation of the secondary folding of VGAM308 folded precursor RNA, herein designated VGAM FOLDED PRECURSOR RNA, of VGAM308 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM308 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 309 (VGAM309) viral gene, which modulates expression of respective host target genes thereof, the function and utility of which host target genes is known in the art.

VGAM309 is a novel bioinformatically detected regulatory, non protein coding, viral micro RNA (miRNA) gene. The method by which VGAM309 was detected is described hereinabove with reference to FIGS. 2-8.

VGAM309 gene, herein designated VGAM GENE, is a viral gene contained in the genome of Vaccinia virus. VGAM309 host target gene, herein designated VGAM HOST TARGET GENE, is a human gene contained in the human genome.

VGAM309 gene, herein designated VGAM GENE, encodes a VGAM309 precursor RNA, herein designated VGAM PRECURSOR RNA. Similar to other miRNA genes, and unlike most ordinary genes, VGAM309 precursor RNA, herein designated VGAM PRECURSOR RNA, does not encode a protein. A nucleotide sequence identical or highly similar to the nucleotide sequence of VGAM309 precursor RNA is designated SEQ ID:295, and is provided hereinbelow with reference to the sequence listing part. Nucleotide sequence SEQ ID:295 is located at position 177929 relative to the genome of Vaccinia virus.

VGAM309 precursor RNA, herein designated VGAM PRECURSOR RNA, folds onto itself, forming VGAM309 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM309 folded precursor RNA, herein designated VGAM FOLDED PRECURSOR RNA, into VGAM309 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 72%) nucleotide sequence of VGAM309 RNA is designated SEQ ID:644, and is provided hereinbelow with reference to the sequence listing part.

VGAM309 host target gene, herein designated VGAM HOST TARGET GENE, encodes a corresponding messenger RNA, VGAM309 host target RNA, herein designated VGAM HOST TARGET RNA. VGAM309 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM309 RNA, herein designated VGAM RNA, binds complementarily to one or more host target binding sites located in untranslated regions of VGAM309 host target RNA, herein designated VGAM HOST TARGET RNA. This complementary binding is due to the fact that the nucleotide sequence of VGAM309 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM309 RNA, herein designated VGAM RNA, may have a different number of host target binding sites in untranslated regions of a VGAM309 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM309 RNA, herein designated VGAM RNA, to host target binding sites on VGAM309 host target RNA, herein designated VGAM HOST TARGET RNA, such as BINDING SITE I, BINDING SITE II and BINDING SITE III, inhibits translation of VGAM309 host target RNA, herein designated VGAM HOST TARGET RNA, into VGAM309 host target protein, herein designated VGAM HOST TARGET PROTEIN. VGAM host target protein is therefore outlined by a broken line.

It is appreciated that VGAM309 host target gene, herein designated VGAM HOST TARGET GENE, in fact represents a plurality of VGAM309 host target genes. The mRNA of each one of this plurality of VGAM309 host target genes comprises one or more host target binding sites, each having a nucleotide sequence which is at least partly complementary to VGAM309 RNA, herein designated VGAM RNA, and which when bound by VGAM309 RNA, herein designated VGAM RNA, causes inhibition of translation of respective one or more VGAM309 host target proteins.

It is further appreciated by one skilled in the art that the mode of translational inhibition illustrated by FIG. 1 with specific reference to translational inhibition exerted by VGAM309 gene, herein designated VGAM GENE, on one or more VGAM309 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM309 is inhibition of expression of host target genes, as part of a novel viral mechanism of attacking a host. Accordingly, utilities of VGAM309 include diagnosis, prevention and treatment of viral infection by Vaccinia virus. Specific functions, and accordingly utilities, of VGAM309 correlate with, and may be deduced from, the identity of the host target genes which VGAM309 binds and inhibits, and the function of these host target genes, as elaborated hereinbelow.

Nucleotide sequences of the VGAM309 precursor RNA, herein designated VGAM PRECURSOR RNA, and of the diced VGAM309 RNA, herein designated VGAM RNA, and a schematic representation of the secondary folding of VGAM309 folded precursor RNA, herein designated VGAM FOLDED PRECURSOR RNA, of VGAM309 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM309 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 310 (VGAM310) viral gene, which modulates expression of respective host target genes thereof, the function and utility of which host target genes is known in the art.

VGAM310 is a novel bioinformatically detected regulatory, non protein coding, viral micro RNA (miRNA) gene. The method by which VGAM310 was detected is described hereinabove with reference to FIGS. 2-8.

VGAM310 gene, herein designated VGAM GENE, is a viral gene contained in the genome of Vaccinia virus. VGAM310 host target gene, herein designated VGAM HOST TARGET GENE, is a human gene contained in the human genome.

VGAM310 gene, herein designated VGAM GENE, encodes a VGAM310 precursor RNA, herein designated VGAM PRECURSOR RNA. Similar to other miRNA genes, and unlike most ordinary genes, VGAM310 precursor RNA, herein designated VGAM PRECURSOR RNA, does not encode a protein. A nucleotide sequence identical or highly similar to the nucleotide sequence of VGAM310 precursor RNA is designated SEQ ID:296, and is provided hereinbelow with reference to the sequence listing part. Nucleotide sequence SEQ ID:296 is located at position 9389 relative to the genome of Vaccinia virus.

VGAM310 precursor RNA, herein designated VGAM PRECURSOR RNA, folds onto itself, forming VGAM310 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM310 folded precursor RNA, herein designated VGAM FOLDED PRECURSOR RNA, into VGAM310 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 70%) nucleotide sequence of VGAM310 RNA is designated SEQ ID:645, and is provided hereinbelow with reference to the sequence listing part.

VGAM310 host target gene, herein designated VGAM HOST TARGET GENE, encodes a corresponding messenger RNA, VGAM310 host target RNA, herein designated VGAM HOST TARGET RNA. VGAM310 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM310 RNA, herein designated VGAM RNA, binds complementarily to one or more host target binding sites located in untranslated regions of VGAM310 host target RNA, herein designated VGAM HOST TARGET RNA. This complementary binding is due to the fact that the nucleotide sequence of VGAM310 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM310 RNA, herein designated VGAM RNA, may have a different number of host target binding sites in untranslated regions of a VGAM310 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM310 RNA, herein designated VGAM RNA, to host target binding sites on VGAM310 host target RNA, herein designated VGAM HOST TARGET RNA, such as BINDING SITE I, BINDING SITE II and BINDING SITE III, inhibits translation of VGAM310 host target RNA, herein designated VGAM HOST TARGET RNA, into VGAM310 host target protein, herein designated VGAM HOST TARGET PROTEIN. VGAM host target protein is therefore outlined by a broken line.

It is appreciated that VGAM310 host target gene, herein designated VGAM HOST TARGET GENE, in fact represents a plurality of VGAM310 host target genes. The mRNA of each one of this plurality of VGAM310 host target genes comprises one or more host target binding sites, each having a nucleotide sequence which is at least partly complementary to VGAM310 RNA, herein designated VGAM RNA, and which when bound by VGAM310 RNA, herein designated VGAM RNA, causes inhibition of translation of respective one or more VGAM310 host target proteins.

It is further appreciated by one skilled in the art that the mode of translational inhibition illustrated by FIG. 1 with specific reference to translational inhibition exerted by VGAM310 gene, herein designated VGAM GENE, on one or more VGAM310 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM310 is inhibition of expression of host target genes, as part of a novel viral mechanism of attacking a host. Accordingly, utilities of VGAM310 include diagnosis, prevention and treatment of viral infection by Vaccinia virus. Specific functions, and accordingly utilities, of VGAM310 correlate with, and may be deduced from, the identity of the host target genes which VGAM310 binds and inhibits, and the function of these host target genes, as elaborated hereinbelow.

Nucleotide sequences of the VGAM310 precursor RNA, herein designated VGAM PRECURSOR RNA, and of the diced VGAM310 RNA, herein designated VGAM RNA, and a schematic representation of the secondary folding of VGAM310 folded precursor RNA, herein designated VGAM FOLDED PRECURSOR RNA, of VGAM310 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM310 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 311 (VGAM311) viral gene, which modulates expression of respective host target genes thereof, the function and utility of which host target genes is known in the art.

VGAM311 is a novel bioinformatically detected regulatory, non protein coding, viral micro RNA (miRNA) gene. The method by which VGAM311 was detected is described hereinabove with reference to FIGS. 2-8.

VGAM311 gene, herein designated VGAM GENE, is a viral gene contained in the genome of Vaccinia virus. VGAM311 host target gene, herein designated VGAM HOST TARGET GENE, is a human gene contained in the human genome.

VGAM311 gene, herein designated VGAM GENE, encodes a VGAM311 precursor RNA, herein designated VGAM PRECURSOR RNA. Similar to other miRNA genes, and unlike most ordinary genes, VGAM311 precursor RNA, herein designated VGAM PRECURSOR RNA, does not encode a protein. A nucleotide sequence identical or highly similar to the nucleotide sequence of VGAM311 precursor RNA is designated SEQ ID:297, and is provided hereinbelow with reference to the sequence listing part. Nucleotide sequence SEQ ID:297 is located at position 176858 relative to the genome of Vaccinia virus.

VGAM311 precursor RNA, herein designated VGAM PRECURSOR RNA, folds onto itself, forming VGAM311 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM311 folded precursor RNA, herein designated VGAM FOLDED PRECURSOR RNA, into VGAM311 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 76%) nucleotide sequence of VGAM311 RNA is designated SEQ ID:646, and is provided hereinbelow with reference to the sequence listing part.

VGAM311 host target gene, herein designated VGAM HOST TARGET GENE, encodes a corresponding messenger RNA, VGAM311 host target RNA, herein designated VGAM HOST TARGET RNA. VGAM311 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM311 RNA, herein designated VGAM RNA, binds complementarily to one or more host target binding sites located in untranslated regions of VGAM311 host target RNA, herein designated VGAM HOST TARGET RNA. This complementary binding is due to the fact that the nucleotide sequence of VGAM311 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM311 RNA, herein designated VGAM RNA, may have a different number of host target binding sites in untranslated regions of a VGAM311 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM311 RNA, herein designated VGAM RNA, to host target binding sites on VGAM311 host target RNA, herein designated VGAM HOST TARGET RNA, such as BINDING SITE I, BINDING SITE II and BINDING SITE III, inhibits translation of VGAM311 host target RNA, herein designated VGAM HOST TARGET RNA, into VGAM311 host target protein, herein designated VGAM HOST TARGET PROTEIN. VGAM host target protein is therefore outlined by a broken line.

It is appreciated that VGAM311 host target gene, herein designated VGAM HOST TARGET GENE, in fact represents a plurality of VGAM311 host target genes. The mRNA of each one of this plurality of VGAM311 host target genes comprises one or more host target binding sites, each having a nucleotide sequence which is at least partly complementary to VGAM311 RNA, herein designated VGAM RNA, and which when bound by VGAM311 RNA, herein designated VGAM RNA, causes inhibition of translation of respective one or more VGAM311 host target proteins.

It is further appreciated by one skilled in the art that the mode of translational inhibition illustrated by FIG. 1 with specific reference to translational inhibition exerted by VGAM311 gene, herein designated VGAM GENE, on one or more VGAM311 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM311 is inhibition of expression of host target genes, as part of a novel viral mechanism of attacking a host. Accordingly, utilities of VGAM311 include diagnosis, prevention and treatment of viral infection by Vaccinia virus. Specific functions, and accordingly utilities, of VGAM311 correlate with, and may be deduced from, the identity of the host target genes which VGAM311 binds and inhibits, and the function of these host target genes, as elaborated hereinbelow.

Nucleotide sequences of the VGAM311 precursor RNA, herein designated VGAM PRECURSOR RNA, and of the diced VGAM311 RNA, herein designated VGAM RNA, and a schematic representation of the secondary folding of VGAM311 folded precursor RNA, herein designated VGAM FOLDED PRECURSOR RNA, of VGAM311 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM311 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 312 (VGAM312) viral gene, which modulates expression of respective host target genes thereof, the function and utility of which host target genes is known in the art.

VGAM312 is a novel bioinformatically detected regulatory, non protein coding, viral micro RNA (miRNA) gene. The method by which VGAM312 was detected is described hereinabove with reference to FIGS. 2-8.

VGAM312 gene, herein designated VGAM GENE, is a viral gene contained in the genome of Vaccinia virus. VGAM312 host target gene, herein designated VGAM HOST TARGET GENE, is a human gene contained in the human genome.

VGAM312 gene, herein designated VGAM GENE, encodes a VGAM312 precursor RNA, herein designated VGAM PRECURSOR RNA. Similar to other miRNA genes, and unlike most ordinary genes, VGAM312 precursor RNA, herein designated VGAM PRECURSOR RNA, does not encode a protein. A nucleotide sequence identical or highly similar to the nucleotide sequence of VGAM312 precursor RNA is designated SEQ ID:298, and is provided hereinbelow with reference to the sequence listing part. Nucleotide sequence SEQ ID:298 is located at position 177797 relative to the genome of Vaccinia virus.

VGAM312 precursor RNA, herein designated VGAM PRECURSOR RNA, folds onto itself, forming VGAM312 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM312 folded precursor RNA, herein designated VGAM FOLDED PRECURSOR RNA, into VGAM312 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 74%) nucleotide sequence of VGAM312 RNA is designated SEQ ID:647, and is provided hereinbelow with reference to the sequence listing part.

VGAM312 host target gene, herein designated VGAM HOST TARGET GENE, encodes a corresponding messenger RNA, VGAM312 host target RNA, herein designated VGAM HOST TARGET RNA. VGAM312 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM312 RNA, herein designated VGAM RNA, binds complementarily to one or more host target binding sites located in untranslated regions of VGAM312 host target RNA, herein designated VGAM HOST TARGET RNA. This complementary binding is due to the fact that the nucleotide sequence of VGAM312 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM312 RNA, herein designated VGAM RNA, may have a different number of host target binding sites in untranslated regions of a VGAM312 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM312 RNA, herein designated VGAM RNA, to host target binding sites on VGAM312 host target RNA, herein designated VGAM HOST TARGET RNA, such as BINDING SITE I, BINDING SITE II and BINDING SITE III, inhibits translation of VGAM312 host target RNA, herein designated VGAM HOST TARGET RNA, into VGAM312 host target protein, herein designated VGAM HOST TARGET PROTEIN. VGAM host target protein is therefore outlined by a broken line.

It is appreciated that VGAM312 host target gene, herein designated VGAM HOST TARGET GENE, in fact represents a plurality of VGAM312 host target genes. The mRNA of each one of this plurality of VGAM312 host target genes comprises one or more host target binding sites, each having a nucleotide sequence which is at least partly complementary to VGAM312 RNA, herein designated VGAM RNA, and which when bound by VGAM312 RNA, herein designated VGAM RNA, causes inhibition of translation of respective one or more VGAM312 host target proteins.

It is further appreciated by one skilled in the art that the mode of translational inhibition illustrated by FIG. 1 with specific reference to translational inhibition exerted by VGAM312 gene, herein designated VGAM GENE, on one or more VGAM312 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM312 is inhibition of expression of host target genes, as part of a novel viral mechanism of attacking a host. Accordingly, utilities of VGAM312 include diagnosis, prevention and treatment of viral infection by Vaccinia virus. Specific functions, and accordingly utilities, of VGAM312 correlate with, and may be deduced from, the identity of the host target genes which VGAM312 binds and inhibits, and the function of these host target genes, as elaborated hereinbelow.

Nucleotide sequences of the VGAM312 precursor RNA, herein designated VGAM PRECURSOR RNA, and of the diced VGAM312 RNA, herein designated VGAM RNA, and a schematic representation of the secondary folding of VGAM312 folded precursor RNA, herein designated VGAM FOLDED PRECURSOR RNA, of VGAM312 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM312 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 313 (VGAM313) viral gene, which modulates expression of respective host target genes thereof, the function and utility of which host target genes is known in the art.

VGAM313 is a novel bioinformatically detected regulatory, non protein coding, viral micro RNA (miRNA) gene. The method by which VGAM313 was detected is described hereinabove with reference to FIGS. 2-8.

VGAM313 gene, herein designated VGAM GENE, is a viral gene contained in the genome of Vaccinia virus.

VGAM313 host target gene, herein designated VGAM HOST TARGET GENE, is a human gene contained in the human genome.

VGAM313 gene, herein designated VGAM GENE, encodes a VGAM313 precursor RNA, herein designated VGAM PRECURSOR RNA. Similar to other miRNA genes, and unlike most ordinary genes, VGAM313 precursor RNA, herein designated VGAM PRECURSOR RNA, does not encode a protein. A nucleotide sequence identical or highly similar to the nucleotide sequence of VGAM313 precursor RNA is designated SEQ ID:299, and is provided hereinbelow with reference to the sequence listing part. Nucleotide sequence SEQ ID:299 is located at position 10272 relative to the genome of Vaccinia virus.

VGAM313 precursor RNA, herein designated VGAM PRECURSOR RNA, folds onto itself, forming VGAM313 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM313 folded precursor RNA, herein designated VGAM FOLDED PRECURSOR RNA, into VGAM313 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM313 RNA is designated SEQ ID:648, and is provided hereinbelow with reference to the sequence listing part.

VGAM313 host target gene, herein designated VGAM HOST TARGET GENE, encodes a corresponding messenger RNA, VGAM313 host target RNA, herein designated VGAM HOST TARGET RNA. VGAM313 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM313 RNA, herein designated VGAM RNA, binds complementarily to one or more host target binding sites located in untranslated regions of VGAM313 host target RNA, herein designated VGAM HOST TARGET RNA. This complementary binding is due to the fact that the nucleotide sequence of VGAM313 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM313 RNA, herein designated VGAM RNA, may have a different number of host target binding sites in untranslated regions of a VGAM313 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM313 RNA, herein designated VGAM RNA, to host target binding sites on VGAM313 host target RNA, herein designated VGAM HOST TARGET RNA, such as BINDING SITE I, BINDING SITE II and BINDING SITE III, inhibits translation of VGAM313 host target RNA, herein designated VGAM HOST TARGET RNA, into VGAM313 host target protein, herein designated VGAM HOST TARGET PROTEIN. VGAM host target protein is therefore outlined by a broken line.

It is appreciated that VGAM313 host target gene, herein designated VGAM HOST TARGET GENE, in fact represents a plurality of VGAM313 host target genes. The mRNA of each one of this plurality of VGAM313 host target genes comprises one or more host target binding sites, each having a nucleotide sequence which is at least partly complementary to VGAM313 RNA, herein designated VGAM RNA, and which when bound by VGAM313 RNA, herein designated VGAM RNA, causes inhibition of translation of respective one or more VGAM313 host target proteins.

It is further appreciated by one skilled in the art that the mode of translational inhibition illustrated by FIG. 1 with specific reference to translational inhibition exerted by VGAM313 gene, herein designated VGAM GENE, on one or more VGAM313 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM313 is inhibition of expression of host target genes, as part of a novel viral mechanism of attacking a host. Accordingly, utilities of VGAM313 include diagnosis, prevention and treatment of viral infection by Vaccinia virus. Specific functions, and accordingly utilities, of VGAM313 correlate with, and may be deduced from, the identity of the host target genes which VGAM313 binds and inhibits, and the function of these host target genes, as elaborated hereinbelow.

Nucleotide sequences of the VGAM313 precursor RNA, herein designated VGAM PRECURSOR RNA, and of the diced VGAM313 RNA, herein designated VGAM RNA, and a schematic representation of the secondary folding of VGAM313 folded precursor RNA, herein designated VGAM FOLDED PRECURSOR RNA, of VGAM313 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM313 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 314 (VGAM314) viral gene, which modulates expression of respective host target genes thereof, the function and utility of which host target genes is known in the art.

VGAM314 is a novel bioinformatically detected regulatory, non protein coding, viral micro RNA (miRNA) gene.

The method by which VGAM314 was detected is described hereinabove with reference to FIGS. 2-8.

VGAM314 gene, herein designated VGAM GENE, is a viral gene contained in the genome of Vaccinia virus. VGAM314 host target gene, herein designated VGAM HOST TARGET GENE, is a human gene contained in the human genome.

VGAM314 gene, herein designated VGAM GENE, encodes a VGAM314 precursor RNA, herein designated VGAM PRECURSOR RNA. Similar to other miRNA genes, and unlike most ordinary genes, VGAM314 precursor RNA, herein designated VGAM PRECURSOR RNA, does not encode a protein. A nucleotide sequence identical or highly similar to the nucleotide sequence of VGAM314 precursor RNA is designated SEQ ID:300, and is provided hereinbelow with reference to the sequence listing part. Nucleotide sequence SEQ ID:300 is located at position 10620 relative to the genome of Vaccinia virus.

VGAM314 precursor RNA, herein designated VGAM PRECURSOR RNA, folds onto itself, forming VGAM314 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM314 folded precursor RNA, herein designated VGAM FOLDED PRECURSOR RNA, into VGAM314 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 86%) nucleotide sequence of VGAM314 RNA is designated SEQ ID:649, and is provided hereinbelow with reference to the sequence listing part.

VGAM314 host target gene, herein designated VGAM HOST TARGET GENE, encodes a corresponding messenger RNA, VGAM314 host target RNA, herein designated VGAM HOST TARGET RNA. VGAM314 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM314 RNA, herein designated VGAM RNA, binds complementarily to one or more host target binding sites located in untranslated regions of VGAM314 host target RNA, herein designated VGAM HOST TARGET RNA. This complementary binding is due to the fact that the nucleotide sequence of VGAM314 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM314 RNA, herein designated VGAM RNA, may have a different number of host target binding sites in untranslated regions of a VGAM314 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM314 RNA, herein designated VGAM RNA, to host target binding sites on VGAM314 host target RNA, herein designated VGAM HOST TARGET RNA, such as BINDING SITE I, BINDING SITE II and BINDING SITE III, inhibits translation of VGAM314 host target RNA, herein designated VGAM HOST TARGET RNA, into VGAM314 host target protein, herein designated VGAM HOST TARGET PROTEIN. VGAM host target protein is therefore outlined by a broken line.

It is appreciated that VGAM314 host target gene, herein designated VGAM HOST TARGET GENE, in fact represents a plurality of VGAM314 host target genes. The mRNA of each one of this plurality of VGAM314 host target genes comprises one or more host target binding sites, each having a nucleotide sequence which is at least partly complementary to VGAM314 RNA, herein designated VGAM RNA, and which when bound by VGAM314 RNA, herein designated VGAM RNA, causes inhibition of translation of respective one or more VGAM314 host target proteins.

It is further appreciated by one skilled in the art that the mode of translational inhibition illustrated by FIG. 1 with specific reference to translational inhibition exerted by VGAM314 gene, herein designated VGAM GENE, on one or more VGAM314 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM314 is inhibition of expression of host target genes, as part of a novel viral mechanism of attacking a host. Accordingly, utilities of VGAM314 include diagnosis, prevention and treatment of viral infection by Vaccinia virus. Specific functions, and accordingly utilities, of VGAM314 correlate with, and may be deduced from, the identity of the host target genes which VGAM314 binds and inhibits, and the function of these host target genes, as elaborated hereinbelow.

Nucleotide sequences of the VGAM314 precursor RNA, herein designated VGAM PRECURSOR RNA, and of the diced VGAM314 RNA, herein designated VGAM RNA, and a schematic representation of the secondary folding of VGAM314 folded precursor RNA, herein designated VGAM FOLDED PRECURSOR RNA, of VGAM314 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM314 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 315 (VGAM315) viral gene, which modulates expression of respective host target genes thereof, the function and utility of which host target genes is known in the art.

VGAM315 is a novel bioinformatically detected regulatory, non protein coding, viral micro RNA (miRNA) gene. The method by which VGAM315 was detected is described hereinabove with reference to FIGS. 2-8.

VGAM315 gene, herein designated VGAM GENE, is a viral gene contained in the genome of Vaccinia virus. VGAM315 host target gene, herein designated VGAM HOST TARGET GENE, is a human gene contained in the human genome.

VGAM315 gene, herein designated VGAM GENE, encodes a VGAM315 precursor RNA, herein designated VGAM PRECURSOR RNA. Similar to other miRNA genes, and unlike most ordinary genes, VGAM315 precursor RNA, herein designated VGAM PRECURSOR RNA, does not encode a protein. A nucleotide sequence identical or highly similar to the nucleotide sequence of VGAM315 precursor RNA is designated SEQ ID:301, and is provided hereinbelow with reference to the sequence listing part. Nucleotide sequence SEQ ID:301 is located at position 179807 relative to the genome of Vaccinia virus.

VGAM315 precursor RNA, herein designated VGAM PRECURSOR RNA, folds onto itself, forming VGAM315 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM315 folded precursor RNA, herein designated VGAM FOLDED PRECURSOR RNA, into VGAM315 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 85%) nucleotide sequence of VGAM315 RNA is designated SEQ ID:650, and is provided hereinbelow with reference to the sequence listing part.

VGAM315 host target gene, herein designated VGAM HOST TARGET GENE, encodes a corresponding messenger RNA, VGAM315 host target RNA, herein designated VGAM HOST TARGET RNA. VGAM315 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM315 RNA, herein designated VGAM RNA, binds complementarily to one or more host target binding sites located in untranslated regions of VGAM315 host target RNA, herein designated VGAM HOST TARGET RNA. This complementary binding is due to the fact that the nucleotide sequence of VGAM315 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM315 RNA, herein designated VGAM RNA, may have a different number of host target binding sites in untranslated regions of a VGAM315 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM315 RNA, herein designated VGAM RNA, to host target binding sites on VGAM315 host target RNA, herein designated VGAM HOST TARGET RNA, such as BINDING SITE I, BINDING SITE II and BINDING SITE III, inhibits translation of VGAM315 host target RNA, herein designated VGAM HOST TARGET RNA, into VGAM315 host target protein, herein designated VGAM HOST TARGET PROTEIN. VGAM host target protein is therefore outlined by a broken line.

It is appreciated that VGAM315 host target gene, herein designated VGAM HOST TARGET GENE, in fact represents a plurality of VGAM315 host target genes. The mRNA of each one of this plurality of VGAM315 host target genes comprises one or more host target binding sites, each having a nucleotide sequence which is at least partly complementary to VGAM315 RNA, herein designated VGAM RNA, and which when bound by VGAM315 RNA, herein designated VGAM RNA, causes inhibition of translation of respective one or more VGAM315 host target proteins.

It is further appreciated by one skilled in the art that the mode of translational inhibition illustrated by FIG. 1 with specific reference to translational inhibition exerted by VGAM315 gene, herein designated VGAM GENE, on one or more VGAM315 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM315 is inhibition of expression of host target genes, as part of a novel viral mechanism of attacking a host. Accordingly, utilities of VGAM315 include diagnosis, prevention and treatment of viral infection by Vaccinia virus. Specific functions, and accordingly utilities, of VGAM315 correlate with, and may be deduced from, the identity of the host target genes which VGAM315 binds and inhibits, and the function of these host target genes, as elaborated hereinbelow.

Nucleotide sequences of the VGAM315 precursor RNA, herein designated VGAM PRECURSOR RNA, and of the diced VGAM315 RNA, herein designated VGAM RNA, and a schematic representation of the secondary folding of VGAM315 folded precursor RNA, herein designated VGAM FOLDED PRECURSOR RNA, of VGAM315 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM315 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 316 (VGAM316) viral gene, which modulates expression of respective host target genes thereof, the function and utility of which host target genes is known in the art.

VGAM316 is a novel bioinformatically detected regulatory, non protein coding, viral micro RNA (miRNA) gene. The method by which VGAM316 was detected is described hereinabove with reference to FIGS. 2-8.

VGAM316 gene, herein designated VGAM GENE, is a viral gene contained in the genome of Vaccinia virus. VGAM316 host target gene, herein designated VGAM HOST TARGET GENE, is a human gene contained in the human genome.

VGAM316 gene, herein designated VGAM GENE, encodes a VGAM316 precursor RNA, herein designated VGAM PRECURSOR RNA. Similar to other miRNA genes, and unlike most ordinary genes, VGAM316 precursor RNA, herein designated VGAM PRECURSOR RNA, does not encode a protein. A nucleotide sequence identical or highly similar to the nucleotide sequence of VGAM316 precursor RNA is designated SEQ ID:302, and is provided hereinbelow with reference to the sequence listing part. Nucleotide sequence SEQ ID:302 is located at position 6123 relative to the genome of Vaccinia virus.

VGAM316 precursor RNA, herein designated VGAM PRECURSOR RNA, folds onto itself, forming VGAM316 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM316 folded precursor RNA, herein designated VGAM FOLDED PRECURSOR RNA, into VGAM316 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM316 RNA is designated SEQ ID:651, and is provided hereinbelow with reference to the sequence listing part.

VGAM316 host target gene, herein designated VGAM HOST TARGET GENE, encodes a corresponding messenger RNA, VGAM316 host target RNA, herein designated VGAM HOST TARGET RNA. VGAM316 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM316 RNA, herein designated VGAM RNA, binds complementarily to one or more host target binding sites located in untranslated regions of VGAM316 host target RNA, herein designated VGAM HOST TARGET RNA. This complementary binding is due to the fact that the nucleotide sequence of VGAM316 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM316 RNA, herein designated VGAM RNA, may have a different number of host target binding sites in untranslated regions of a VGAM316 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM316 RNA, herein designated VGAM RNA, to host target binding sites on VGAM316 host target RNA, herein designated VGAM HOST TARGET RNA, such as BINDING SITE I, BINDING SITE II and BINDING SITE III, inhibits translation of VGAM316 host target RNA, herein designated VGAM HOST TARGET RNA, into VGAM316 host target protein, herein designated VGAM HOST TARGET PROTEIN. VGAM host target protein is therefore outlined by a broken line.

It is appreciated that VGAM316 host target gene, herein designated VGAM HOST TARGET GENE, in fact represents a plurality of VGAM316 host target genes. The mRNA of each one of this plurality of VGAM316 host target genes comprises one or more host target binding sites, each having a nucleotide sequence which is at least partly complementary to VGAM316 RNA, herein designated VGAM RNA, and which when bound by VGAM316 RNA, herein designated VGAM RNA, causes inhibition of translation of respective one or more VGAM316 host target proteins.

It is further appreciated by one skilled in the art that the mode of translational inhibition illustrated by FIG. 1 with specific reference to translational inhibition exerted by VGAM316 gene, herein designated VGAM GENE, on one or more VGAM316 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM316 is inhibition of expression of host target genes, as part of a novel viral mechanism of attacking a host. Accordingly, utilities of VGAM316 include diagnosis, prevention and treatment of viral infection by Vaccinia virus. Specific functions, and accordingly utilities, of VGAM316 correlate with, and may be deduced from, the identity of the host target genes which VGAM316 binds and inhibits, and the function of these host target genes, as elaborated hereinbelow.

Nucleotide sequences of the VGAM316 precursor RNA, herein designated VGAM PRECURSOR RNA, and of the diced VGAM316 RNA, herein designated VGAM RNA, and a schematic representation of the secondary folding of VGAM316 folded precursor RNA, herein designated VGAM FOLDED PRECURSOR RNA, of VGAM316 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM316 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 317 (VGAM317) viral gene, which modulates expression of respective host target genes thereof, the function and utility of which host target genes is known in the art.

VGAM317 is a novel bioinformatically detected regulatory, non protein coding, viral micro RNA (miRNA) gene. The method by which VGAM317 was detected is described hereinabove with reference to FIGS. 2-8.

VGAM317 gene, herein designated VGAM GENE, is a viral gene contained in the genome of Vaccinia virus. VGAM317 host target gene, herein designated VGAM HOST TARGET GENE, is a human gene contained in the human genome.

VGAM317 gene, herein designated VGAM GENE, encodes a VGAM317 precursor RNA, herein designated VGAM PRECURSOR RNA. Similar to other miRNA genes, and unlike most ordinary genes, VGAM317 precursor RNA, herein designated VGAM PRECURSOR RNA, does not encode a protein. A nucleotide sequence identical or highly similar to the nucleotide sequence of VGAM317 precursor RNA is designated SEQ ID:303, and is provided hereinbelow with reference to the sequence listing part. Nucleotide sequence SEQ ID:303 is located at position 6573 relative to the genome of Vaccinia virus.

VGAM317 precursor RNA, herein designated VGAM PRECURSOR RNA, folds onto itself, forming VGAM317 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM317 folded precursor RNA, herein designated VGAM FOLDED PRECURSOR RNA, into VGAM317 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM317 RNA is designated SEQ ID:652, and is provided hereinbelow with reference to the sequence listing part.

VGAM317 host target gene, herein designated VGAM HOST TARGET GENE, encodes a corresponding messenger RNA, VGAM317 host target RNA, herein designated VGAM HOST TARGET RNA. VGAM317 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM317 RNA, herein designated VGAM RNA, binds complementarily to one or more host target binding sites located in untranslated regions of VGAM317 host target RNA, herein designated VGAM HOST TARGET RNA. This complementary binding is due to the fact that the nucleotide sequence of VGAM317 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM317 RNA, herein designated VGAM RNA, may have a different number of host target binding sites in untranslated regions of a VGAM317 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM317 RNA, herein designated VGAM RNA, to host target binding sites on VGAM317 host target RNA, herein designated VGAM HOST TARGET RNA, such as BINDING SITE I, BINDING SITE II and BINDING SITE III, inhibits translation of VGAM317 host target RNA, herein designated VGAM HOST TARGET RNA, into VGAM317 host target protein, herein designated VGAM HOST TARGET PROTEIN. VGAM host target protein is therefore outlined by a broken line.

It is appreciated that VGAM317 host target gene, herein designated VGAM HOST TARGET GENE, in fact represents a plurality of VGAM317 host target genes. The mRNA of each one of this plurality of VGAM317 host target genes comprises one or more host target binding sites, each having a nucleotide sequence which is at least partly complementary to VGAM317 RNA, herein designated VGAM RNA, and which when bound by VGAM317 RNA, herein designated VGAM RNA, causes inhibition of translation of respective one or more VGAM317 host target proteins.

It is further appreciated by one skilled in the art that the mode of translational inhibition illustrated by FIG. 1 with specific reference to translational inhibition exerted by VGAM317 gene, herein designated VGAM GENE, on one or more VGAM317 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM317 is inhibition of expression of host target genes, as part of a novel viral mechanism of attacking a host. Accordingly, utilities of VGAM317 include diagnosis, prevention and treatment of viral infection by Vaccinia virus. Specific functions, and accordingly utilities, of VGAM317 correlate with, and may be deduced from, the identity of the host target genes which VGAM317 binds and inhibits, and the function of these host target genes, as elaborated hereinbelow.

Nucleotide sequences of the VGAM317 precursor RNA, herein designated VGAM PRECURSOR RNA, and of the diced VGAM317 RNA, herein designated VGAM RNA, and a schematic representation of the secondary folding of VGAM317 folded precursor RNA, herein designated VGAM FOLDED PRECURSOR RNA, of VGAM317 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM317 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 318 (VGAM318) viral gene, which modulates expression of respective host target genes thereof, the function and utility of which host target genes is known in the art.

VGAM318 is a novel bioinformatically detected regulatory, non protein coding, viral micro RNA (miRNA) gene. The method by which VGAM318 was detected is described hereinabove with reference to FIGS. 2-8.

VGAM318 gene, herein designated VGAM GENE, is a viral gene contained in the genome of Vaccinia virus. VGAM318 host target gene, herein designated VGAM HOST TARGET GENE, is a human gene contained in the human genome.

VGAM318 gene, herein designated VGAM GENE, encodes a VGAM318 precursor RNA, herein designated VGAM PRECURSOR RNA. Similar to other miRNA genes, and unlike most ordinary genes, VGAM318 precursor RNA, herein designated VGAM PRECURSOR RNA, does not encode a protein. A nucleotide sequence identical or highly similar to the nucleotide sequence of VGAM318 precursor RNA is designated SEQ ID:304, and is provided hereinbelow with reference to the sequence listing part. Nucleotide sequence SEQ ID:304 is located at position 5257 relative to the genome of Vaccinia virus.

VGAM318 precursor RNA, herein designated VGAM PRECURSOR RNA, folds onto itself, forming VGAM318 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM318 folded precursor RNA, herein designated VGAM FOLDED PRECURSOR RNA, into VGAM318 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM318 RNA is designated SEQ ID:653, and is provided hereinbelow with reference to the sequence listing part.

VGAM318 host target gene, herein designated VGAM HOST TARGET GENE, encodes a corresponding messenger RNA, VGAM318 host target RNA, herein designated VGAM HOST TARGET RNA. VGAM318 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM318 RNA, herein designated VGAM RNA, binds complementarily to one or more host target binding sites located in untranslated regions of VGAM318 host target RNA, herein designated VGAM HOST TARGET RNA. This complementary binding is due to the fact that the nucleotide sequence of VGAM318 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM318 RNA, herein designated VGAM RNA, may have a different number of host target binding sites in untranslated regions of a VGAM318 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM318 RNA, herein designated VGAM RNA, to host target binding sites on VGAM318 host target RNA, herein designated VGAM HOST TARGET RNA, such as BINDING SITE I, BINDING SITE II and BINDING SITE III, inhibits translation of VGAM318 host target RNA, herein designated VGAM HOST TARGET RNA, into VGAM318 host target protein, herein designated VGAM HOST TARGET PROTEIN. VGAM host target protein is therefore outlined by a broken line.

It is appreciated that VGAM318 host target gene, herein designated VGAM HOST TARGET GENE, in fact represents a plurality of VGAM318 host target genes. The mRNA of each one of this plurality of VGAM318 host target genes comprises one or more host target binding sites, each having a nucleotide sequence which is at least partly complementary to VGAM318 RNA, herein designated VGAM RNA, and which when bound by VGAM318 RNA, herein designated VGAM RNA, causes inhibition of translation of respective one or more VGAM318 host target proteins.

It is further appreciated by one skilled in the art that the mode of translational inhibition illustrated by FIG. 1 with specific reference to translational inhibition exerted by VGAM318 gene, herein designated VGAM GENE, on one or more VGAM318 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM318 is inhibition of expression of host target genes, as part of a novel viral mechanism of attacking a host. Accordingly, utilities of VGAM318 include diagnosis, prevention and treatment of viral infection by Vaccinia virus. Specific functions, and accordingly utilities, of VGAM318 correlate with, and may be deduced from, the identity of the host target genes which VGAM318 binds and inhibits, and the function of these host target genes, as elaborated hereinbelow.

Nucleotide sequences of the VGAM318 precursor RNA, herein designated VGAM PRECURSOR RNA, and of the diced VGAM318 RNA, herein designated VGAM RNA, and a schematic representation of the secondary folding of VGAM318 folded precursor RNA, herein designated VGAM FOLDED PRECURSOR RNA, of VGAM318 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM318 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 319 (VGAM319) viral gene, which modulates expression of respective host target genes thereof, the function and utility of which host target genes is known in the art.

VGAM319 is a novel bioinformatically detected regulatory, non protein coding, viral micro RNA (miRNA) gene. The method by which VGAM319 was detected is described hereinabove with reference to FIGS. 2-8.

VGAM319 gene, herein designated VGAM GENE, is a viral gene contained in the genome of Vaccinia virus. VGAM319 host target gene, herein designated VGAM HOST TARGET GENE, is a human gene contained in the human genome.

VGAM319 gene, herein designated VGAM GENE, encodes a VGAM319 precursor RNA, herein designated VGAM PRECURSOR RNA. Similar to other miRNA genes, and unlike most ordinary genes, VGAM319 precursor RNA, herein designated VGAM PRECURSOR RNA, does not encode a protein. A nucleotide sequence identical or highly similar to the nucleotide sequence of VGAM319 precursor RNA is designated SEQ ID:305, and is provided hereinbelow with reference to the sequence listing part. Nucleotide sequence SEQ ID:305 is located at position 4867 relative to the genome of Vaccinia virus.

VGAM319 precursor RNA, herein designated VGAM PRECURSOR RNA, folds onto itself, forming VGAM319 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM319 folded precursor RNA, herein designated VGAM FOLDED PRECURSOR RNA, into VGAM319 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM319 RNA is designated SEQ ID:654, and is provided hereinbelow with reference to the sequence listing part.

VGAM319 host target gene, herein designated VGAM HOST TARGET GENE, encodes a corresponding messenger RNA, VGAM319 host target RNA, herein designated VGAM HOST TARGET RNA. VGAM319 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM319 RNA, herein designated VGAM RNA, binds complementarily to one or more host target binding sites located in untranslated regions of VGAM319 host target RNA, herein designated VGAM HOST TARGET RNA. This complementary binding is due to the fact that the nucleotide sequence of VGAM319 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM319 RNA, herein designated VGAM RNA, may have a different number of host target binding sites in untranslated regions of a VGAM319 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM319 RNA, herein designated VGAM RNA, to host target binding sites on VGAM319 host target RNA, herein designated VGAM HOST TARGET RNA, such as BINDING SITE I, BINDING SITE II and BINDING SITE III, inhibits translation of VGAM319 host target RNA, herein designated VGAM HOST TARGET RNA, into VGAM319 host target protein, herein designated VGAM HOST TARGET PROTEIN. VGAM host target protein is therefore outlined by a broken line.

It is appreciated that VGAM319 host target gene, herein designated VGAM HOST TARGET GENE, in fact represents a plurality of VGAM319 host target genes. The mRNA of each one of this plurality of VGAM319 host target genes comprises one or more host target binding sites, each having a nucleotide sequence which is at least partly complementary to VGAM319 RNA, herein designated VGAM RNA, and which when bound by VGAM319 RNA, herein designated VGAM RNA, causes inhibition of translation of respective one or more VGAM319 host target proteins.

It is further appreciated by one skilled in the art that the mode of translational inhibition illustrated by FIG. 1 with specific reference to translational inhibition exerted by VGAM319 gene, herein designated VGAM GENE, on one or more VGAM319 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM319 is inhibition of expression of host target genes, as part of a novel viral mechanism of attacking a host. Accordingly, utilities of VGAM319 include diagnosis, prevention and treatment of viral infection by Vaccinia virus. Specific functions, and accordingly utilities, of VGAM319 correlate with, and may be deduced from, the identity of the host target genes which VGAM319 binds and inhibits, and the function of these host target genes, as elaborated hereinbelow.

Nucleotide sequences of the VGAM319 precursor RNA, herein designated VGAM PRECURSOR RNA, and of the diced VGAM319 RNA, herein designated VGAM RNA, and a schematic representation of the secondary folding of VGAM319 folded precursor RNA, herein designated VGAM FOLDED PRECURSOR RNA, of VGAM319 are further described hereinbelow with reference to Table 1.

Nucleotide sequences of host target binding sites, such as BINDING SITE-I, BINDING SITE-II and BINDING SITE- III of FIG. 1, found on, and schematic representation of the complementarity of each of these host target binding sites to VGAM319 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 320 (VGAM320) viral gene, which modulates expression of respective host target genes thereof, the function and utility of which host target genes is known in the art.

VGAM320 is a novel bioinformatically detected regulatory, non protein coding, viral micro RNA (miRNA) gene. The method by which VGAM320 was detected is described hereinabove with reference to FIGS. 2-8.

VGAM320 gene, herein designated VGAM GENE, is a viral gene contained in the genome of Vaccinia virus. VGAM320 host target gene, herein designated VGAM HOST TARGET GENE, is a human gene contained in the human genome.

VGAM320 gene, herein designated VGAM GENE, encodes a VGAM320 precursor RNA, herein designated VGAM PRECURSOR RNA. Similar to other miRNA genes, and unlike most ordinary genes, VGAM320 precursor RNA, herein designated VGAM PRECURSOR RNA, does not encode a protein. A nucleotide sequence identical or highly similar to the nucleotide sequence of VGAM320 precursor RNA is designated SEQ ID:306, and is provided hereinbelow with reference to the sequence listing part. Nucleotide sequence SEQ ID:306 is located at position 190678 relative to the genome of Vaccinia virus.

VGAM320 precursor RNA, herein designated VGAM PRECURSOR RNA, folds onto itself, forming VGAM320 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM320 folded precursor RNA, herein designated VGAM FOLDED PRECURSOR RNA, into VGAM320 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 83%) nucleotide sequence of VGAM320 RNA is designated SEQ ID:655, and is provided hereinbelow with reference to the sequence listing part.

VGAM320 host target gene, herein designated VGAM HOST TARGET GENE, encodes a corresponding messenger RNA, VGAM320 host target RNA, herein designated VGAM HOST TARGET RNA. VGAM320 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM320 RNA, herein designated VGAM RNA, binds complementarily to one or more host target binding sites located in untranslated regions of VGAM320 host target RNA, herein designated VGAM HOST TARGET RNA. This complementary binding is due to the fact that the nucleotide sequence of VGAM320 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM320 RNA, herein designated VGAM RNA, may have a different number of host target binding sites in untranslated regions of a VGAM320 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM320 RNA, herein designated VGAM RNA, to host target binding sites on VGAM320 host target RNA, herein designated VGAM HOST TARGET RNA, such as BINDING SITE I, BINDING SITE II and BINDING SITE III, inhibits translation of VGAM320 host target RNA, herein designated VGAM HOST TARGET RNA, into VGAM320 host target protein, herein designated VGAM HOST TARGET PROTEIN. VGAM host target protein is therefore outlined by a broken line.

It is appreciated that VGAM320 host target gene, herein designated VGAM HOST TARGET GENE, in fact represents a plurality of VGAM320 host target genes. The mRNA of each one of this plurality of VGAM320 host target genes comprises one or more host target binding sites, each having a nucleotide sequence which is at least partly complementary to VGAM320 RNA, herein designated VGAM RNA, and which when bound by VGAM320 RNA, herein designated VGAM RNA, causes inhibition of translation of respective one or more VGAM320 host target proteins.

It is further appreciated by one skilled in the art that the mode of translational inhibition illustrated by FIG. 1 with specific reference to translational inhibition exerted by VGAM320 gene, herein designated VGAM GENE, on one or more VGAM320 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM320 is inhibition of expression of host target genes, as part of a novel viral mechanism of attacking a host. Accordingly, utilities of VGAM320 include diagnosis, prevention and treatment of viral infection by Vaccinia virus. Specific functions, and accordingly utilities, of VGAM320 correlate with, and may be deduced from, the identity of the host target genes which VGAM320 binds and inhibits, and the function of these host target genes, as elaborated hereinbelow.

Nucleotide sequences of the VGAM320 precursor RNA, herein designated VGAM PRECURSOR RNA, and of the diced VGAM320 RNA, herein designated VGAM RNA, and a schematic representation of the secondary folding of VGAM320 folded precursor RNA, herein designated VGAM FOLDED PRECURSOR RNA, of VGAM320 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM320 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 321 (VGAM321) viral gene, which modulates expression of respective host target genes thereof, the function and utility of which host target genes is known in the art.

VGAM321 is a novel bioinformatically detected regulatory, non protein coding, viral micro RNA (miRNA) gene. The method by which VGAM321 was detected is described hereinabove with reference to FIGS. 2-8.

VGAM321 gene, herein designated VGAM GENE, is a viral gene contained in the genome of Vaccinia virus. VGAM321 host target gene, herein designated VGAM HOST TARGET GENE, is a human gene contained in the human genome.

VGAM321 gene, herein designated VGAM GENE, encodes a VGAM321 precursor RNA, herein designated VGAM PRECURSOR RNA. Similar to other miRNA genes, and unlike most ordinary genes, VGAM321 precursor RNA, herein designated VGAM PRECURSOR RNA, does not encode a protein. A nucleotide sequence identical or highly similar to the nucleotide sequence of VGAM321 precursor RNA is designated SEQ ID:307, and is provided hereinbelow with reference to the sequence listing part. Nucleotide sequence SEQ ID:307 is located at position 188927 relative to the genome of Vaccinia virus.

VGAM321 precursor RNA, herein designated VGAM PRECURSOR RNA, folds onto itself, forming VGAM321 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM321 folded precursor RNA, herein designated VGAM FOLDED PRECURSOR RNA, into VGAM321 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM321 RNA is designated SEQ ID:656, and is provided hereinbelow with reference to the sequence listing part.

VGAM321 host target gene, herein designated VGAM HOST TARGET GENE, encodes a corresponding messenger RNA, VGAM321 host target RNA, herein designated VGAM HOST TARGET RNA. VGAM321 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM321 RNA, herein designated VGAM RNA, binds complementarily to one or more host target binding sites located in untranslated regions of VGAM321 host target RNA, herein designated VGAM HOST TARGET RNA. This complementary binding is due to the fact that the nucleotide sequence of VGAM321 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM321 RNA, herein designated VGAM RNA, may have a different number of host target binding sites in untranslated regions of a VGAM321 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM321 RNA, herein designated VGAM RNA, to host target binding sites on VGAM321 host target RNA, herein designated VGAM HOST TARGET RNA, such as BINDING SITE I, BINDING SITE II and BINDING SITE III, inhibits translation of VGAM321 host target RNA, herein designated VGAM HOST TARGET RNA, into VGAM321 host target protein, herein designated VGAM HOST TARGET PROTEIN. VGAM host target protein is therefore outlined by a broken line.

It is appreciated that VGAM321 host target gene, herein designated VGAM HOST TARGET GENE, in fact represents a plurality of VGAM321 host target genes. The mRNA of each one of this plurality of VGAM321 host target genes comprises one or more host target binding sites, each having a nucleotide sequence which is at least partly complementary to VGAM321 RNA, herein designated VGAM RNA, and which when bound by VGAM321 RNA, herein designated VGAM RNA, causes inhibition of translation of respective one or more VGAM321 host target proteins.

It is further appreciated by one skilled in the art that the mode of translational inhibition illustrated by FIG. 1 with specific reference to translational inhibition exerted by VGAM321 gene, herein designated VGAM GENE, on one or more VGAM321 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM321 is inhibition of expression of host target genes, as part of a novel viral mechanism of attacking a host. Accordingly, utilities of VGAM321 include diagnosis, prevention and treatment of viral infection by Vaccinia virus. Specific functions, and accordingly utilities, of VGAM321 correlate with, and may be deduced from, the identity of the host target genes which VGAM321 binds and inhibits, and the function of these host target genes, as elaborated hereinbelow.

Nucleotide sequences of the VGAM321 precursor RNA, herein designated VGAM PRECURSOR RNA, and of the diced VGAM321 RNA, herein designated VGAM RNA, and a schematic representation of the secondary folding of VGAM321 folded precursor RNA, herein designated VGAM FOLDED PRECURSOR RNA, of VGAM321 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM321 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 322 (VGAM322) viral gene, which modulates expression of respective host target genes thereof, the function and utility of which host target genes is known in the art.

VGAM322 is a novel bioinformatically detected regulatory, non protein coding, viral micro RNA (miRNA) gene. The method by which VGAM322 was detected is described hereinabove with reference to FIGS. 2-8.

VGAM322 gene, herein designated VGAM GENE, is a viral gene contained in the genome of Vaccinia virus. VGAM322 host target gene, herein designated VGAM HOST TARGET GENE, is a human gene contained in the human genome.

VGAM322 gene, herein designated VGAM GENE, encodes a VGAM322 precursor RNA, herein designated VGAM PRECURSOR RNA. Similar to other miRNA genes, and unlike most ordinary genes, VGAM322 precursor RNA, herein designated VGAM PRECURSOR RNA, does not encode a protein. A nucleotide sequence identical or highly similar to the nucleotide sequence of VGAM322 precursor RNA is designated SEQ ID:308, and is provided hereinbelow with reference to the sequence listing part. Nucleotide sequence SEQ ID:308 is located at position 188927 relative to the genome of Vaccinia virus.

VGAM322 precursor RNA, herein designated VGAM PRECURSOR RNA, folds onto itself, forming VGAM322 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM322 folded precursor RNA, herein designated VGAM FOLDED PRECURSOR RNA, into VGAM322 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM322 RNA is designated SEQ ID:657, and is provided hereinbelow with reference to the sequence listing part.

VGAM322 host target gene, herein designated VGAM HOST TARGET GENE, encodes a corresponding messenger RNA, VGAM322 host target RNA, herein designated VGAM HOST TARGET RNA. VGAM322 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM322 RNA, herein designated VGAM RNA, binds complementarily to one or more host target binding sites located in untranslated regions of VGAM322 host target RNA, herein designated VGAM HOST TARGET RNA. This complementary binding is due to the fact that the nucleotide sequence of VGAM322 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM322 RNA, herein designated VGAM RNA, may have a different number of host target binding sites in untranslated regions of a VGAM322 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM322 RNA, herein designated VGAM RNA, to host target binding sites on VGAM322 host target RNA, herein designated VGAM HOST TARGET RNA, such as BINDING SITE I, BINDING SITE II and BINDING SITE III, inhibits translation of VGAM322 host target RNA, herein designated VGAM HOST TARGET RNA, into VGAM322 host target protein, herein designated VGAM HOST TARGET PROTEIN. VGAM host target protein is therefore outlined by a broken line.

It is appreciated that VGAM322 host target gene, herein designated VGAM HOST TARGET GENE, in fact represents a plurality of VGAM322 host target genes. The mRNA of each one of this plurality of VGAM322 host target genes comprises one or more host target binding sites, each having a nucleotide sequence which is at least partly complementary to VGAM322 RNA, herein designated VGAM RNA, and which when bound by VGAM322 RNA, herein designated VGAM RNA, causes inhibition of translation of respective one or more VGAM322 host target proteins.

It is further appreciated by one skilled in the art that the mode of translational inhibition illustrated by FIG. 1 with specific reference to translational inhibition exerted by VGAM322 gene, herein designated VGAM GENE, on one or more VGAM322 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM322 is inhibition of expression of host target genes, as part of a novel viral mechanism of attacking a host. Accordingly, utilities of VGAM322 include diagnosis, prevention and treatment of viral infection by Vaccinia virus. Specific functions, and accordingly utilities, of VGAM322 correlate with, and may be deduced from, the identity of the host target genes which VGAM322 binds and inhibits, and the function of these host target genes, as elaborated hereinbelow.

Nucleotide sequences of the VGAM322 precursor RNA, herein designated VGAM PRECURSOR RNA, and of the diced VGAM322 RNA, herein designated VGAM RNA, and a schematic representation of the secondary folding of VGAM322 folded precursor RNA, herein designated VGAM FOLDED PRECURSOR RNA, of VGAM322 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM322 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 323 (VGAM323) viral gene, which modulates expression of respective host target genes thereof, the function and utility of which host target genes is known in the art.

VGAM323 is a novel bioinformatically detected regulatory, non protein coding, viral micro RNA (miRNA) gene. The method by which VGAM323 was detected is described hereinabove with reference to FIGS. 2-8.

VGAM323 gene, herein designated VGAM GENE, is a viral gene contained in the genome of Vaccinia virus. VGAM323 host target gene, herein designated VGAM HOST TARGET GENE, is a human gene contained in the human genome.

VGAM323 gene, herein designated VGAM GENE, encodes a VGAM323 precursor RNA, herein designated VGAM PRECURSOR RNA. Similar to other miRNA genes, and unlike most ordinary genes, VGAM323 precursor RNA, herein designated VGAM PRECURSOR RNA, does not encode a protein. A nucleotide sequence identical or highly similar to the nucleotide sequence of VGAM323 precursor RNA is designated SEQ ID:309, and is provided hereinbelow with reference to the sequence listing part. Nucleotide sequence SEQ ID:309 is located at position 188927 relative to the genome of Vaccinia virus.

VGAM323 precursor RNA, herein designated VGAM PRECURSOR RNA, folds onto itself, forming VGAM323 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM323 folded precursor RNA, herein designated VGAM FOLDED PRECURSOR RNA, into VGAM323 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM323 RNA is designated SEQ ID:658, and is provided hereinbelow with reference to the sequence listing part.

VGAM323 host target gene, herein designated VGAM HOST TARGET GENE, encodes a corresponding messenger RNA, VGAM323 host target RNA, herein designated VGAM HOST TARGET RNA. VGAM323 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM323 RNA, herein designated VGAM RNA, binds complementarily to one or more host target binding sites located in untranslated regions of VGAM323 host target RNA, herein designated VGAM HOST TARGET RNA. This complementary binding is due to the fact that the nucleotide sequence of VGAM323 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM323 RNA, herein designated VGAM RNA, may have a different number of host target binding sites in untranslated regions of a VGAM323 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM323 RNA, herein designated VGAM RNA, to host target binding sites on VGAM323 host target RNA, herein designated VGAM HOST TARGET RNA, such as BINDING SITE I, BINDING SITE II and BINDING SITE III, inhibits translation of VGAM323 host target RNA, herein designated VGAM HOST TARGET RNA, into VGAM323 host target protein, herein designated VGAM HOST TARGET PROTEIN. VGAM host target protein is therefore outlined by a broken line.

It is appreciated that VGAM323 host target gene, herein designated VGAM HOST TARGET GENE, in fact represents a plurality of VGAM323 host target genes. The mRNA of each one of this plurality of VGAM323 host target genes comprises one or more host target binding sites, each having a nucleotide sequence which is at least partly complementary to VGAM323 RNA, herein designated VGAM RNA, and which when bound by VGAM323 RNA, herein designated VGAM RNA, causes inhibition of translation of respective one or more VGAM323 host target proteins.

It is further appreciated by one skilled in the art that the mode of translational inhibition illustrated by FIG. 1 with specific reference to translational inhibition exerted by VGAM323 gene, herein designated VGAM GENE, on one or more VGAM323 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM323 is inhibition of expression of host target genes, as part of a novel viral mechanism of attacking a host. Accordingly, utilities of VGAM323 include diagnosis, prevention and treatment of viral infection by Vaccinia virus. Specific functions, and accordingly utilities, of VGAM323 correlate with, and may be deduced from, the identity of the host target genes which VGAM323 binds and inhibits, and the function of these host target genes, as elaborated hereinbelow.

Nucleotide sequences of the VGAM323 precursor RNA, herein designated VGAM PRECURSOR RNA, and of the diced VGAM323 RNA, herein designated VGAM RNA, and a schematic representation of the secondary folding of VGAM323 folded precursor RNA, herein designated VGAM FOLDED PRECURSOR RNA, of VGAM323 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM323 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 324 (VGAM324) viral gene, which modulates expression of respective host target genes thereof, the function and utility of which host target genes is known in the art.

VGAM324 is a novel bioinformatically detected regulatory, non protein coding, viral micro RNA (miRNA) gene. The method by which VGAM324 was detected is described hereinabove with reference to FIGS. 2-8.

VGAM324 gene, herein designated VGAM GENE, is a viral gene contained in the genome of Vaccinia virus. VGAM324 host target gene, herein designated VGAM HOST TARGET GENE, is a human gene contained in the human genome.

VGAM324 gene, herein designated VGAM GENE, encodes a VGAM324 precursor RNA, herein designated VGAM PRECURSOR RNA. Similar to other miRNA genes, and unlike most ordinary genes, VGAM324 precursor RNA, herein designated VGAM PRECURSOR RNA, does not encode a protein. A nucleotide sequence identical or highly similar to the nucleotide sequence of VGAM324 precursor RNA is designated SEQ ID:310, and is provided hereinbelow with reference to the sequence listing part. Nucleotide sequence SEQ ID:310 is located at position 188927 relative to the genome of Vaccinia virus.

VGAM324 precursor RNA, herein designated VGAM PRECURSOR RNA, folds onto itself, forming VGAM324 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM324 folded precursor RNA, herein designated VGAM FOLDED PRECURSOR RNA, into VGAM324 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM324 RNA is designated SEQ ID:659, and is provided hereinbelow with reference to the sequence listing part.

VGAM324 host target gene, herein designated VGAM HOST TARGET GENE, encodes a corresponding messenger RNA, VGAM324 host target RNA, herein designated VGAM HOST TARGET RNA. VGAM324 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM324 RNA, herein designated VGAM RNA, binds complementarily to one or more host target binding sites located in untranslated regions of VGAM324 host target RNA, herein designated VGAM HOST TARGET RNA. This complementary binding is due to the fact that the nucleotide sequence of VGAM324 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM324 RNA, herein designated VGAM RNA, may have a different number of host target binding sites in untranslated regions of a VGAM324 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM324 RNA, herein designated VGAM RNA, to host target binding sites on VGAM324 host target RNA, herein designated VGAM HOST TARGET RNA, such as BINDING SITE I, BINDING SITE II and BINDING SITE III, inhibits translation of VGAM324 host target RNA, herein designated VGAM HOST TARGET RNA, into VGAM324 host target protein, herein designated VGAM HOST TARGET PROTEIN. VGAM host target protein is therefore outlined by a broken line.

It is appreciated that VGAM324 host target gene, herein designated VGAM HOST TARGET GENE, in fact represents a plurality of VGAM324 host target genes. The mRNA of each one of this plurality of VGAM324 host target genes comprises one or more host target binding sites, each having a nucleotide sequence which is at least partly complementary to VGAM324 RNA, herein designated VGAM RNA, and which when bound by VGAM324 RNA, herein designated VGAM RNA, causes inhibition of translation of respective one or more VGAM324 host target proteins.

It is further appreciated by one skilled in the art that the mode of translational inhibition illustrated by FIG. 1 with specific reference to translational inhibition exerted by VGAM324 gene, herein designated VGAM GENE, on one or more VGAM324 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM324 is inhibition of expression of host target genes, as part of a novel viral mechanism of attacking a host. Accordingly, utilities of VGAM324 include diagnosis, prevention and treatment of viral infection by Vaccinia virus. Specific functions, and accordingly utilities, of VGAM324 correlate with, and may be deduced from, the identity of the host target genes which VGAM324 binds and inhibits, and the function of these host target genes, as elaborated hereinbelow.

Nucleotide sequences of the VGAM324 precursor RNA, herein designated VGAM PRECURSOR RNA, and of the diced VGAM324 RNA, herein designated VGAM RNA, and a schematic representation of the secondary folding of VGAM324 folded precursor RNA, herein designated VGAM FOLDED PRECURSOR RNA, of VGAM324 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM324 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 325 (VGAM325) viral gene, which modulates expression of respective host target genes thereof, the function and utility of which host target genes is known in the art.

VGAM325 is a novel bioinformatically detected regulatory, non protein coding, viral micro RNA (miRNA) gene. The method by which VGAM325 was detected is described hereinabove with reference to FIGS. 2-8.

VGAM325 gene, herein designated VGAM GENE, is a viral gene contained in the genome of Vaccinia virus. VGAM325 host target gene, herein designated VGAM HOST TARGET GENE, is a human gene contained in the human genome.

VGAM325 gene, herein designated VGAM GENE, encodes a VGAM325 precursor RNA, herein designated VGAM PRECURSOR RNA. Similar to other miRNA genes, and unlike most ordinary genes, VGAM325 precursor RNA, herein designated VGAM PRECURSOR RNA, does not encode a protein. A nucleotide sequence identical or highly similar to the nucleotide sequence of VGAM325 precursor RNA is designated SEQ ID:311, and is provided hereinbelow with reference to the sequence listing part. Nucleotide sequence SEQ ID:311 is located at position 188927 relative to the genome of Vaccinia virus.

VGAM325 precursor RNA, herein designated VGAM PRECURSOR RNA, folds onto itself, forming VGAM325 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM325 folded precursor RNA, herein designated VGAM FOLDED PRECURSOR RNA, into VGAM325 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM325 RNA is designated SEQ ID:660, and is provided hereinbelow with reference to the sequence listing part.

VGAM325 host target gene, herein designated VGAM HOST TARGET GENE, encodes a corresponding messenger RNA, VGAM325 host target RNA, herein designated VGAM HOST TARGET RNA. VGAM325 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM325 RNA, herein designated VGAM RNA, binds complementarily to one or more host target binding sites located in untranslated regions of VGAM325 host target RNA, herein designated VGAM HOST TARGET RNA. This complementary binding is due to the fact that the nucleotide sequence of VGAM325 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM325 RNA, herein designated VGAM RNA, may have a different number of host target binding sites in untranslated regions of a VGAM325 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM325 RNA, herein designated VGAM RNA, to host target binding sites on VGAM325 host target RNA, herein designated VGAM HOST TARGET RNA, such as BINDING SITE I, BINDING SITE II and BINDING SITE III, inhibits translation of VGAM325 host target RNA, herein designated VGAM HOST TARGET RNA, into VGAM325 host target protein, herein designated VGAM HOST TARGET PROTEIN. VGAM host target protein is therefore outlined by a broken line.

It is appreciated that VGAM325 host target gene, herein designated VGAM HOST TARGET GENE, in fact represents a plurality of VGAM325 host target genes. The mRNA of each one of this plurality of VGAM325 host target genes comprises one or more host target binding sites, each having a nucleotide sequence which is at least partly complementary to VGAM325 RNA, herein designated VGAM RNA, and which when bound by VGAM325 RNA, herein designated VGAM RNA, causes inhibition of translation of respective one or more VGAM325 host target proteins.

It is further appreciated by one skilled in the art that the mode of translational inhibition illustrated by FIG. 1 with specific reference to translational inhibition exerted by VGAM325 gene, herein designated VGAM GENE, on one or more VGAM325 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM325 is inhibition of expression of host target genes, as part of a novel viral mechanism of attacking a host. Accordingly, utilities of VGAM325 include diagnosis, prevention and treatment of viral infection by Vaccinia virus. Specific functions, and accordingly utilities, of VGAM325 correlate with, and may be deduced from, the identity of the host target genes which VGAM325 binds and inhibits, and the function of these host target genes, as elaborated hereinbelow.

Nucleotide sequences of the VGAM325 precursor RNA, herein designated VGAM PRECURSOR RNA, and of the diced VGAM325 RNA, herein designated VGAM RNA, and a schematic representation of the secondary folding of VGAM325 folded precursor RNA, herein designated VGAM FOLDED PRECURSOR RNA, of VGAM325 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM325 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 326 (VGAM326) viral gene, which modulates expression of respective host target genes thereof, the function and utility of which host target genes is known in the art.

VGAM326 is a novel bioinformatically detected regulatory, non protein coding, viral micro RNA (miRNA) gene. The method by which VGAM326 was detected is described hereinabove with reference to FIGS. 2-8.

VGAM326 gene, herein designated VGAM GENE, is a viral gene contained in the genome of Vaccinia virus. VGAM326 host target gene, herein designated VGAM HOST TARGET GENE, is a human gene contained in the human genome.

VGAM326 gene, herein designated VGAM GENE, encodes a VGAM326 precursor RNA, herein designated VGAM PRECURSOR RNA. Similar to other miRNA genes, and unlike most ordinary genes, VGAM326 precursor RNA, herein designated VGAM PRECURSOR RNA, does not encode a protein. A nucleotide sequence identical or highly similar to the nucleotide sequence of VGAM326 precursor RNA is designated SEQ ID:312, and is provided hereinbelow with reference to the sequence listing part. Nucleotide sequence SEQ ID:312 is located at position 188927 relative to the genome of Vaccinia virus.

VGAM326 precursor RNA, herein designated VGAM PRECURSOR RNA, folds onto itself, forming VGAM326 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM326 folded precursor RNA, herein designated VGAM FOLDED PRECURSOR RNA, into VGAM326 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM326 RNA is designated SEQ ID:661, and is provided hereinbelow with reference to the sequence listing part.

VGAM326 host target gene, herein designated VGAM HOST TARGET GENE, encodes a corresponding messenger RNA, VGAM326 host target RNA, herein designated VGAM HOST TARGET RNA. VGAM326 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM326 RNA, herein designated VGAM RNA, binds complementarily to one or more host target binding sites located in untranslated regions of VGAM326 host target RNA, herein designated VGAM HOST TARGET RNA. This complementary binding is due to the fact that the nucleotide sequence of VGAM326 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM326 RNA, herein designated VGAM RNA, may have a different number of host target binding sites in untranslated regions of a VGAM326 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM326 RNA, herein designated VGAM RNA, to host target binding sites on VGAM326 host target RNA, herein designated VGAM HOST TARGET RNA, such as BINDING SITE I, BINDING SITE II and BINDING SITE III, inhibits translation of VGAM326 host target RNA, herein designated VGAM HOST TARGET RNA, into VGAM326 host target protein, herein designated VGAM HOST TARGET PROTEIN. VGAM host target protein is therefore outlined by a broken line.

It is appreciated that VGAM326 host target gene, herein designated VGAM HOST TARGET GENE, in fact represents a plurality of VGAM326 host target genes. The mRNA of each one of this plurality of VGAM326 host target genes comprises one or more host target binding sites, each having a nucleotide sequence which is at least partly complementary to VGAM326 RNA, herein designated VGAM RNA, and which when bound by VGAM326 RNA, herein designated VGAM RNA, causes inhibition of translation of respective one or more VGAM326 host target proteins.

It is further appreciated by one skilled in the art that the mode of translational inhibition illustrated by FIG. 1 with specific reference to translational inhibition exerted by VGAM326 gene, herein designated VGAM GENE, on one or more VGAM326 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM326 is inhibition of expression of host target genes, as part of a novel viral mechanism of attacking a host. Accordingly, utilities of VGAM326 include diagnosis, prevention and treatment of viral infection by Vaccinia virus. Specific functions, and accordingly utilities, of VGAM326 correlate with, and may be deduced from, the identity of the host target genes which VGAM326 binds and inhibits, and the function of these host target genes, as elaborated hereinbelow.

Nucleotide sequences of the VGAM326 precursor RNA, herein designated VGAM PRECURSOR RNA, and of the diced VGAM326 RNA, herein designated VGAM RNA, and a schematic representation of the secondary folding of VGAM326 folded precursor RNA, herein designated VGAM FOLDED PRECURSOR RNA, of VGAM326 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM326 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 327 (VGAM327) viral gene, which modulates expression of respective host target genes thereof, the function and utility of which host target genes is known in the art.

VGAM327 is a novel bioinformatically detected regulatory, non protein coding, viral micro RNA (miRNA) gene. The method by which VGAM327 was detected is described hereinabove with reference to FIGS. 2-8.

VGAM327 gene, herein designated VGAM GENE, is a viral gene contained in the genome of Vaccinia virus. VGAM327 host target gene, herein designated VGAM HOST TARGET GENE, is a human gene contained in the human genome.

VGAM327 gene, herein designated VGAM GENE, encodes a VGAM327 precursor RNA, herein designated VGAM PRECURSOR RNA. Similar to other miRNA genes, and unlike most ordinary genes, VGAM327 precursor RNA, herein designated VGAM PRECURSOR RNA, does not encode a protein. A nucleotide sequence identical or highly similar to the nucleotide sequence of VGAM327 precursor RNA is designated SEQ ID:313, and is provided hereinbelow with reference to the sequence listing part. Nucleotide sequence SEQ ID:313 is located at position 188927 relative to the genome of Vaccinia virus.

VGAM327 precursor RNA, herein designated VGAM PRECURSOR RNA, folds onto itself, forming VGAM327 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM327 folded precursor RNA, herein designated VGAM FOLDED PRECURSOR RNA, into VGAM327 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM327 RNA is designated SEQ ID:662, and is provided hereinbelow with reference to the sequence listing part.

VGAM327 host target gene, herein designated VGAM HOST TARGET GENE, encodes a corresponding messenger RNA, VGAM327 host target RNA, herein designated VGAM HOST TARGET RNA. VGAM327 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM327 RNA, herein designated VGAM RNA, binds complementarily to one or more host target binding sites located in untranslated regions of VGAM327 host target RNA, herein designated VGAM HOST TARGET RNA. This complementary binding is due to the fact that the nucleotide sequence of VGAM327 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM327 RNA, herein designated VGAM RNA, may have a different number of host target binding sites in untranslated regions of a VGAM327 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM327 RNA, herein designated VGAM RNA, to host target binding sites on VGAM327 host target RNA, herein designated VGAM HOST TARGET RNA, such as BINDING SITE I, BINDING SITE II and BINDING SITE III, inhibits translation of VGAM327 host target RNA, herein designated VGAM HOST TARGET RNA, into VGAM327 host target protein, herein designated VGAM HOST TARGET PROTEIN. VGAM host target protein is therefore outlined by a broken line.

It is appreciated that VGAM327 host target gene, herein designated VGAM HOST TARGET GENE, in fact represents a plurality of VGAM327 host target genes. The mRNA of each one of this plurality of VGAM327 host target genes comprises one or more host target binding sites, each having a nucleotide sequence which is at least partly complementary to VGAM327 RNA, herein designated VGAM RNA, and which when bound by VGAM327 RNA, herein designated VGAM RNA, causes inhibition of translation of respective one or more VGAM327 host target proteins.

It is further appreciated by one skilled in the art that the mode of translational inhibition illustrated by FIG. 1 with specific reference to translational inhibition exerted by VGAM327 gene, herein designated VGAM GENE, on one or more VGAM327 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM327 is inhibition of expression of host target genes, as part of a novel viral mechanism of attacking a host. Accordingly, utilities of VGAM327 include diagnosis, prevention and treatment of viral infection by Vaccinia virus. Specific functions, and accordingly utilities, of VGAM327 correlate with, and may be deduced from, the identity of the host target genes which VGAM327 binds and inhibits, and the function of these host target genes, as elaborated hereinbelow.

Nucleotide sequences of the VGAM327 precursor RNA, herein designated VGAM PRECURSOR RNA, and of the diced VGAM327 RNA, herein designated VGAM RNA, and a schematic representation of the secondary folding of VGAM327 folded precursor RNA, herein designated VGAM FOLDED PRECURSOR RNA, of VGAM327 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM327 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 328 (VGAM328) viral gene, which modulates expression of respective host target genes thereof, the function and utility of which host target genes is known in the art.

VGAM328 is a novel bioinformatically detected regulatory, non protein coding, viral micro RNA (miRNA) gene. The method by which VGAM328 was detected is described hereinabove with reference to FIGS. 2-8.

VGAM328 gene, herein designated VGAM GENE, is a viral gene contained in the genome of Vaccinia virus. VGAM328 host target gene, herein designated VGAM HOST TARGET GENE, is a human gene contained in the human genome.

VGAM328 gene, herein designated VGAM GENE, encodes a VGAM328 precursor RNA, herein designated VGAM PRECURSOR RNA. Similar to other miRNA genes, and unlike most ordinary genes, VGAM328 precursor RNA, herein designated VGAM PRECURSOR RNA, does not encode a protein. A nucleotide sequence identical or highly similar to the nucleotide sequence of VGAM328 precursor RNA is designated SEQ ID:314, and is provided hereinbelow with reference to the sequence listing part. Nucleotide sequence SEQ ID:314 is located at position 188927 relative to the genome of Vaccinia virus.

VGAM328 precursor RNA, herein designated VGAM PRECURSOR RNA, folds onto itself, forming VGAM328 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM328 folded precursor RNA, herein designated VGAM FOLDED PRECURSOR RNA, into VGAM328 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM328 RNA is designated SEQ ID:663, and is provided hereinbelow with reference to the sequence listing part.

VGAM328 host target gene, herein designated VGAM HOST TARGET GENE, encodes a corresponding messenger RNA, VGAM328 host target RNA, herein designated VGAM HOST TARGET RNA. VGAM328 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM328 RNA, herein designated VGAM RNA, binds complementarily to one or more host target binding sites located in untranslated regions of VGAM328 host target RNA, herein designated VGAM HOST TARGET RNA. This complementary binding is due to the fact that the nucleotide sequence of VGAM328 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM328 RNA, herein designated VGAM RNA, may have a different number of host target binding sites in untranslated regions of a VGAM328 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM328 RNA, herein designated VGAM RNA, to host target binding sites on VGAM328 host target RNA, herein designated VGAM HOST TARGET RNA, such as BINDING SITE I, BINDING SITE II and BINDING SITE III, inhibits translation of VGAM328 host target RNA, herein designated VGAM HOST TARGET RNA, into VGAM328 host target protein, herein designated VGAM HOST TARGET PROTEIN. VGAM host target protein is therefore outlined by a broken line.

It is appreciated that VGAM328 host target gene, herein designated VGAM HOST TARGET GENE, in fact represents a plurality of VGAM328 host target genes. The mRNA of each one of this plurality of VGAM328 host target genes comprises one or more host target binding sites, each having a nucleotide sequence which is at least partly complementary to VGAM328 RNA, herein designated VGAM RNA, and which when bound by VGAM328 RNA, herein designated VGAM RNA, causes inhibition of translation of respective one or more VGAM328 host target proteins.

It is further appreciated by one skilled in the art that the mode of translational inhibition illustrated by FIG. 1 with specific reference to translational inhibition exerted by VGAM328 gene, herein designated VGAM GENE, on one or more VGAM328 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM328 is inhibition of expression of host target genes, as part of a novel viral mechanism of attacking a host. Accordingly, utilities of VGAM328 include diagnosis, prevention and treatment of viral infection by Vaccinia virus. Specific functions, and accordingly utilities, of VGAM328 correlate with, and may be deduced from, the identity of the host target genes which VGAM328 binds and inhibits, and the function of these host target genes, as elaborated hereinbelow.

Nucleotide sequences of the VGAM328 precursor RNA, herein designated VGAM PRECURSOR RNA, and of the diced VGAM328 RNA, herein designated VGAM RNA, and a schematic representation of the secondary folding of VGAM328 folded precursor RNA, herein designated VGAM FOLDED PRECURSOR RNA, of VGAM328 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM328 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 329 (VGAM329) viral gene, which modulates expression of respective host target genes thereof, the function and utility of which host target genes is known in the art.

VGAM329 is a novel bioinformatically detected regulatory, non protein coding, viral micro RNA (miRNA) gene. The method by which VGAM329 was detected is described hereinabove with reference to FIGS. 2-8.

VGAM329 gene, herein designated VGAM GENE, is a viral gene contained in the genome of Vaccinia virus. VGAM329 host target gene, herein designated VGAM HOST TARGET GENE, is a human gene contained in the human genome.

VGAM329 gene, herein designated VGAM GENE, encodes a VGAM329 precursor RNA, herein designated VGAM PRECURSOR RNA. Similar to other miRNA genes, and unlike most ordinary genes, VGAM329 precursor RNA, herein designated VGAM PRECURSOR RNA, does not encode a protein. A nucleotide sequence identical or highly similar to the nucleotide sequence of VGAM329 precursor RNA is designated SEQ ID:315, and is provided hereinbelow with reference to the sequence listing part. Nucleotide sequence SEQ ID:315 is located at position 188927 relative to the genome of Vaccinia virus.

VGAM329 precursor RNA, herein designated VGAM PRECURSOR RNA, folds onto itself, forming VGAM329 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM329 folded precursor RNA, herein designated VGAM FOLDED PRECURSOR RNA, into VGAM329 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM329 RNA is designated SEQ ID:664, and is provided hereinbelow with reference to the sequence listing part.

VGAM329 host target gene, herein designated VGAM HOST TARGET GENE, encodes a corresponding messenger RNA, VGAM329 host target RNA, herein designated VGAM HOST TARGET RNA. VGAM329 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM329 RNA, herein designated VGAM RNA, binds complementarily to one or more host target binding sites located in untranslated regions of VGAM329 host target RNA, herein designated VGAM HOST TARGET RNA. This complementary binding is due to the fact that the nucleotide sequence of VGAM329 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM329 RNA, herein designated VGAM RNA, may have a different number of host target binding sites in untranslated regions of a VGAM329 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM329 RNA, herein designated VGAM RNA, to host target binding sites on VGAM329 host target RNA, herein designated VGAM HOST TARGET RNA, such as BINDING SITE I, BINDING SITE II and BINDING SITE III, inhibits translation of VGAM329 host target RNA, herein designated VGAM HOST TARGET RNA, into VGAM329 host target protein, herein designated VGAM HOST TARGET PROTEIN. VGAM host target protein is therefore outlined by a broken line.

It is appreciated that VGAM329 host target gene, herein designated VGAM HOST TARGET GENE, in fact represents a plurality of VGAM329 host target genes. The mRNA of each one of this plurality of VGAM329 host target genes comprises one or more host target binding sites, each having a nucleotide sequence which is at least partly complementary to VGAM329 RNA, herein designated VGAM RNA, and which when bound by VGAM329 RNA, herein designated VGAM RNA, causes inhibition of translation of respective one or more VGAM329 host target proteins.

It is further appreciated by one skilled in the art that the mode of translational inhibition illustrated by FIG. 1 with specific reference to translational inhibition exerted by VGAM329 gene, herein designated VGAM GENE, on one or more VGAM329 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM329 is inhibition of expression of host target genes, as part of a novel viral mechanism of attacking a host. Accordingly, utilities of VGAM329 include diagnosis, prevention and treatment of viral infection by Vaccinia virus. Specific functions, and accordingly utilities, of VGAM329 correlate with, and may be deduced from, the identity of the host target genes which VGAM329 binds and inhibits, and the function of these host target genes, as elaborated hereinbelow.

Nucleotide sequences of the VGAM329 precursor RNA, herein designated VGAM PRECURSOR RNA, and of the diced VGAM329 RNA, herein designated VGAM RNA, and a schematic representation of the secondary folding of VGAM329 folded precursor RNA, herein designated VGAM FOLDED PRECURSOR RNA, of VGAM329 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM329 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 330 (VGAM330) viral gene, which modulates expression of respective host target genes thereof, the function and utility of which host target genes is known in the art.

VGAM330 is a novel bioinformatically detected regulatory, non protein coding, viral micro RNA (miRNA) gene. The method by which VGAM330 was detected is described hereinabove with reference to FIGS. 2-8.

VGAM330 gene, herein designated VGAM GENE, is a viral gene contained in the genome of Vaccinia virus. VGAM330 host target gene, herein designated VGAM HOST TARGET GENE, is a human gene contained in the human genome.

VGAM330 gene, herein designated VGAM GENE, encodes a VGAM330 precursor RNA, herein designated VGAM PRECURSOR RNA. Similar to other miRNA genes, and unlike most ordinary genes, VGAM330 precursor RNA, herein designated VGAM PRECURSOR RNA, does not encode a protein. A nucleotide sequence identical or highly similar to the nucleotide sequence of VGAM330 precursor RNA is designated SEQ ID:316, and is provided hereinbelow with reference to the sequence listing part. Nucleotide sequence SEQ ID:316 is located at position 188927 relative to the genome of Vaccinia virus.

VGAM330 precursor RNA, herein designated VGAM PRECURSOR RNA, folds onto itself, forming VGAM330 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM330 folded precursor RNA, herein designated VGAM FOLDED PRECURSOR RNA, into VGAM330 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM330 RNA is designated SEQ ID:665, and is provided hereinbelow with reference to the sequence listing part.

VGAM330 host target gene, herein designated VGAM HOST TARGET GENE, encodes a corresponding messenger RNA, VGAM330 host target RNA, herein designated VGAM HOST TARGET RNA. VGAM330 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM330 RNA, herein designated VGAM RNA, binds complementarily to one or more host target binding sites located in untranslated regions of VGAM330 host target RNA, herein designated VGAM HOST TARGET RNA. This complementary binding is due to the fact that the nucleotide sequence of VGAM330 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM330 RNA, herein designated VGAM RNA, may have a different number of host target binding sites in untranslated regions of a VGAM330 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM330 RNA, herein designated VGAM RNA, to host target binding sites on VGAM330 host target RNA, herein designated VGAM HOST TARGET RNA, such as BINDING SITE I, BINDING SITE II and BINDING SITE III, inhibits translation of VGAM330 host target RNA, herein designated VGAM HOST TARGET RNA, into VGAM330 host target protein, herein designated VGAM HOST TARGET PROTEIN. VGAM host target protein is therefore outlined by a broken line.

It is appreciated that VGAM330 host target gene, herein designated VGAM HOST TARGET GENE, in fact represents a plurality of VGAM330 host target genes. The mRNA of each one of this plurality of VGAM330 host target genes comprises one or more host target binding sites, each having a nucleotide sequence which is at least partly complementary to VGAM330 RNA, herein designated VGAM RNA, and which when bound by VGAM330 RNA, herein designated VGAM RNA, causes inhibition of translation of respective one or more VGAM330 host target proteins.

It is further appreciated by one skilled in the art that the mode of translational inhibition illustrated by FIG. 1 with specific reference to translational inhibition exerted by VGAM330 gene, herein designated VGAM GENE, on one or more VGAM330 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM330 is inhibition of expression of host target genes, as part of a novel viral mechanism of attacking a host. Accordingly, utilities of VGAM330 include diagnosis, prevention and treatment of viral infection by Vaccinia virus. Specific functions, and accordingly utilities, of VGAM330 correlate with, and may be deduced from, the identity of the host target genes which VGAM330 binds and inhibits, and the function of these host target genes, as elaborated hereinbelow.

Nucleotide sequences of the VGAM330 precursor RNA, herein designated VGAM PRECURSOR RNA, and of the diced VGAM330 RNA, herein designated VGAM RNA, and a schematic representation of the secondary folding of VGAM330 folded precursor RNA, herein designated VGAM FOLDED PRECURSOR RNA, of VGAM330 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM330 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 331 (VGAM331) viral gene, which modulates expression of respective host target genes thereof, the function and utility of which host target genes is known in the art.

VGAM331 is a novel bioinformatically detected regulatory, non protein coding, viral micro RNA (miRNA) gene. The method by which VGAM331 was detected is described hereinabove with reference to FIGS. 2-8.

VGAM331 gene, herein designated VGAM GENE, is a viral gene contained in the genome of Vaccinia virus. VGAM331 host target gene, herein designated VGAM HOST TARGET GENE, is a human gene contained in the human genome.

VGAM331 gene, herein designated VGAM GENE, encodes a VGAM331 precursor RNA, herein designated VGAM PRECURSOR RNA. Similar to other miRNA genes, and unlike most ordinary genes, VGAM331 precursor RNA, herein designated VGAM PRECURSOR RNA, does not encode a protein. A nucleotide sequence identical or highly similar to the nucleotide sequence of VGAM331 precursor RNA is designated SEQ ID:317, and is provided hereinbelow with reference to the sequence listing part. Nucleotide sequence SEQ ID:317 is located at position 189067 relative to the genome of Vaccinia virus.

VGAM331 precursor RNA, herein designated VGAM PRECURSOR RNA, folds onto itself, forming VGAM331 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM331 folded precursor RNA, herein designated VGAM FOLDED PRECURSOR RNA, into VGAM331 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 78%) nucleotide sequence of VGAM331 RNA is designated SEQ ID:666, and is provided hereinbelow with reference to the sequence listing part.

VGAM331 host target gene, herein designated VGAM HOST TARGET GENE, encodes a corresponding messenger RNA, VGAM331 host target RNA, herein designated VGAM HOST TARGET RNA. VGAM331 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM331 RNA, herein designated VGAM RNA, binds complementarily to one or more host target binding sites located in untranslated regions of VGAM331 host target RNA, herein designated VGAM HOST TARGET RNA. This complementary binding is due to the fact that the nucleotide sequence of VGAM331 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM331 RNA, herein designated VGAM RNA, may have a different number of host target binding sites in untranslated regions of a VGAM331 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM331 RNA, herein designated VGAM RNA, to host target binding sites on VGAM331 host target RNA, herein designated VGAM HOST TARGET RNA, such as BINDING SITE I, BINDING SITE II and BINDING SITE III, inhibits translation of VGAM331 host target RNA, herein designated VGAM HOST TARGET RNA, into VGAM331 host target protein, herein designated VGAM HOST TARGET PROTEIN. VGAM host target protein is therefore outlined by a broken line.

It is appreciated that VGAM331 host target gene, herein designated VGAM HOST TARGET GENE, in fact represents a plurality of VGAM331 host target genes. The mRNA of each one of this plurality of VGAM331 host target genes comprises one or more host target binding sites, each having a nucleotide sequence which is at least partly complementary to VGAM331 RNA, herein designated VGAM RNA, and which when bound by VGAM331 RNA, herein designated VGAM RNA, causes inhibition of translation of respective one or more VGAM331 host target proteins.

It is further appreciated by one skilled in the art that the mode of translational inhibition illustrated by FIG. 1 with specific reference to translational inhibition exerted by VGAM331 gene, herein designated VGAM GENE, on one or more VGAM331 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM331 is inhibition of expression of host target genes, as part of a novel viral mechanism of attacking a host. Accordingly, utilities of VGAM331 include diagnosis, prevention and treatment of viral infection by Vaccinia virus. Specific functions, and accordingly utilities, of VGAM331 correlate with, and may be deduced from, the identity of the host target genes which VGAM331 binds and inhibits, and the function of these host target genes, as elaborated hereinbelow.

Nucleotide sequences of the VGAM331 precursor RNA, herein designated VGAM PRECURSOR RNA, and of the diced VGAM331 RNA, herein designated VGAM RNA, and a schematic representation of the secondary folding of VGAM331 folded precursor RNA, herein designated VGAM FOLDED PRECURSOR RNA, of VGAM331 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM331 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 332 (VGAM332) viral gene, which modulates expression of respective host target genes thereof, the function and utility of which host target genes is known in the art.

VGAM332 is a novel bioinformatically detected regulatory, non protein coding, viral micro RNA (miRNA) gene. The method by which VGAM332 was detected is described hereinabove with reference to FIGS. 2-8.

VGAM332 gene, herein designated VGAM GENE, is a viral gene contained in the genome of Vaccinia virus. VGAM332 host target gene, herein designated VGAM HOST TARGET GENE, is a human gene contained in the human genome.

VGAM332 gene, herein designated VGAM GENE, encodes a VGAM332 precursor RNA, herein designated VGAM PRECURSOR RNA. Similar to other miRNA genes, and unlike most ordinary genes, VGAM332 precursor RNA, herein designated VGAM PRECURSOR RNA, does not encode a protein. A nucleotide sequence identical or highly similar to the nucleotide sequence of VGAM332 precursor RNA is designated SEQ ID:318, and is provided hereinbelow with reference to the sequence listing part. Nucleotide sequence SEQ ID:318 is located at position 11 relative to the genome of Vaccinia virus.

VGAM332 precursor RNA, herein designated VGAM PRECURSOR RNA, folds onto itself, forming VGAM332 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM332 folded precursor RNA, herein designated VGAM FOLDED PRECURSOR RNA, into VGAM332 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM332 RNA is designated SEQ ID:667, and is provided hereinbelow with reference to the sequence listing part.

VGAM332 host target gene, herein designated VGAM HOST TARGET GENE, encodes a corresponding messenger RNA, VGAM332 host target RNA, herein designated VGAM HOST TARGET RNA. VGAM332 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM332 RNA, herein designated VGAM RNA, binds complementarily to one or more host target binding sites located in untranslated regions of VGAM332 host target RNA, herein designated VGAM HOST TARGET RNA. This complementary binding is due to the fact that the nucleotide sequence of VGAM332 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM332 RNA, herein designated VGAM RNA, may have a different number of host target binding sites in untranslated regions of a VGAM332 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM332 RNA, herein designated VGAM RNA, to host target binding sites on VGAM332 host target RNA, herein designated VGAM HOST TARGET RNA, such as BINDING SITE I, BINDING SITE II and BINDING SITE III, inhibits translation of VGAM332 host target RNA, herein designated VGAM HOST TARGET RNA, into VGAM332 host target protein, herein designated VGAM HOST TARGET PROTEIN. VGAM host target protein is therefore outlined by a broken line.

It is appreciated that VGAM332 host target gene, herein designated VGAM HOST TARGET GENE, in fact represents a plurality of VGAM332 host target genes. The mRNA of each one of this plurality of VGAM332 host target genes comprises one or more host target binding sites, each having a nucleotide sequence which is at least partly complementary to VGAM332 RNA, herein designated VGAM RNA, and which when bound by VGAM332 RNA, herein designated VGAM RNA, causes inhibition of translation of respective one or more VGAM332 host target proteins.

It is further appreciated by one skilled in the art that the mode of translational inhibition illustrated by FIG. 1 with specific reference to translational inhibition exerted by VGAM332 gene, herein designated VGAM GENE, on one or more VGAM332 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM332 is inhibition of expression of host target genes, as part of a novel viral mechanism of attacking a host. Accordingly, utilities of VGAM332 include diagnosis, prevention and treatment of viral infection by Vaccinia virus. Specific functions, and accordingly utilities, of VGAM332 correlate with, and may be deduced from, the identity of the host target genes which VGAM332 binds and inhibits, and the function of these host target genes, as elaborated hereinbelow.

Nucleotide sequences of the VGAM332 precursor RNA, herein designated VGAM PRECURSOR RNA, and of the diced VGAM332 RNA, herein designated VGAM RNA, and a schematic representation of the secondary folding of VGAM332 folded precursor RNA, herein designated VGAM FOLDED PRECURSOR RNA, of VGAM332 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM332 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 333 (VGAM333) viral gene, which modulates expression of respective host target genes thereof, the function and utility of which host target genes is known in the art.

VGAM333 is a novel bioinformatically detected regulatory, non protein coding, viral micro RNA (miRNA) gene. The method by which VGAM333 was detected is described hereinabove with reference to FIGS. 2-8.

VGAM333 gene, herein designated VGAM GENE, is a viral gene contained in the genome of Vaccinia virus. VGAM333 host target gene, herein designated VGAM HOST TARGET GENE, is a human gene contained in the human genome.

VGAM333 gene, herein designated VGAM GENE, encodes a VGAM333 precursor RNA, herein designated VGAM PRECURSOR RNA. Similar to other miRNA genes, and unlike most ordinary genes, VGAM333 precursor RNA, herein designated VGAM PRECURSOR RNA, does not encode a protein. A nucleotide sequence identical or highly similar to the nucleotide sequence of VGAM333 precursor RNA is designated SEQ ID:319, and is provided hereinbelow with reference to the sequence listing part. Nucleotide sequence SEQ ID:319 is located at position 190758 relative to the genome of Vaccinia virus.

VGAM333 precursor RNA, herein designated VGAM PRECURSOR RNA, folds onto itself, forming VGAM333 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM333 folded precursor RNA, herein designated VGAM FOLDED PRECURSOR RNA, into VGAM333 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM333 RNA is designated SEQ ID:668, and is provided hereinbelow with reference to the sequence listing part.

VGAM333 host target gene, herein designated VGAM HOST TARGET GENE, encodes a corresponding messenger RNA, VGAM333 host target RNA, herein designated VGAM HOST TARGET RNA. VGAM333 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM333 RNA, herein designated VGAM RNA, binds complementarily to one or more host target binding sites located in untranslated regions of VGAM333 host target RNA, herein designated VGAM HOST TARGET RNA. This complementary binding is due to the fact that the nucleotide sequence of VGAM333 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM333 RNA, herein designated VGAM RNA, may have a different number of host target binding sites in untranslated regions of a VGAM333 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM333 RNA, herein designated VGAM RNA, to host target binding sites on VGAM333 host target RNA, herein designated VGAM HOST TARGET RNA, such as BINDING SITE I, BINDING SITE II and BINDING SITE III, inhibits translation of VGAM333 host target RNA, herein designated VGAM HOST TARGET RNA, into VGAM333 host target protein, herein designated VGAM HOST TARGET PROTEIN. VGAM host target protein is therefore outlined by a broken line.

It is appreciated that VGAM333 host target gene, herein designated VGAM HOST TARGET GENE, in fact represents a plurality of VGAM333 host target genes. The mRNA of each one of this plurality of VGAM333 host target genes comprises one or more host target binding sites, each having a nucleotide sequence which is at least partly complementary to VGAM333 RNA, herein designated VGAM RNA, and which when bound by VGAM333 RNA, herein designated VGAM RNA, causes inhibition of translation of respective one or more VGAM333 host target proteins.

It is further appreciated by one skilled in the art that the mode of translational inhibition illustrated by FIG. 1 with specific reference to translational inhibition exerted by VGAM333 gene, herein designated VGAM GENE, on one or more VGAM333 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM333 is inhibition of expression of host target genes, as part of a novel viral mechanism of attacking a host. Accordingly, utilities of VGAM333 include diagnosis, prevention and treatment of viral infection by Vaccinia virus. Specific functions, and accordingly utilities, of VGAM333 correlate with, and may be deduced from, the identity of the host target genes which VGAM333 binds and inhibits, and the function of these host target genes, as elaborated hereinbelow.

Nucleotide sequences of the VGAM333 precursor RNA, herein designated VGAM PRECURSOR RNA, and of the diced VGAM333 RNA, herein designated VGAM RNA, and a schematic representation of the secondary folding of VGAM333 folded precursor RNA, herein designated VGAM FOLDED PRECURSOR RNA, of VGAM333 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM333 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 334 (VGAM334) viral gene, which modulates expression of respective host target genes thereof, the function and utility of which host target genes is known in the art.

VGAM334 is a novel bioinformatically detected regulatory, non protein coding, viral micro RNA (miRNA) gene. The method by which VGAM334 was detected is described hereinabove with reference to FIGS. 2-8.

VGAM334 gene, herein designated VGAM GENE, is a viral gene contained in the genome of Vaccinia virus. VGAM334 host target gene, herein designated VGAM HOST TARGET GENE, is a human gene contained in the human genome.

VGAM334 gene, herein designated VGAM GENE, encodes a VGAM334 precursor RNA, herein designated VGAM PRECURSOR RNA. Similar to other miRNA genes, and unlike most ordinary genes, VGAM334 precursor RNA, herein designated VGAM PRECURSOR RNA, does not encode a protein. A nucleotide sequence identical or highly similar to the nucleotide sequence of VGAM334 precursor RNA is designated SEQ ID:320, and is provided hereinbelow with reference to the sequence listing part. Nucleotide sequence SEQ ID:320 is located at position 190758 relative to the genome of Vaccinia virus.

VGAM334 precursor RNA, herein designated VGAM PRECURSOR RNA, folds onto itself, forming VGAM334 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM334 folded precursor RNA, herein designated VGAM FOLDED PRECURSOR RNA, into VGAM334 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM334 RNA is designated SEQ ID:669, and is provided hereinbelow with reference to the sequence listing part.

VGAM334 host target gene, herein designated VGAM HOST TARGET GENE, encodes a corresponding messenger RNA, VGAM334 host target RNA, herein designated VGAM HOST TARGET RNA. VGAM334 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM334 RNA, herein designated VGAM RNA, binds complementarily to one or more host target binding sites located in untranslated regions of VGAM334 host target RNA, herein designated VGAM HOST TARGET RNA. This complementary binding is due to the fact that the nucleotide sequence of VGAM334 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting. VGAM334 RNA, herein designated VGAM RNA, may have a different number of host target binding sites in untranslated regions of a VGAM334 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM334 RNA, herein designated VGAM RNA, to host target binding sites on VGAM334 host target RNA, herein designated VGAM HOST TARGET RNA, such as BINDING SITE I, BINDING SITE II and BINDING SITE III, inhibits translation of VGAM334 host target RNA, herein designated VGAM HOST TARGET RNA, into VGAM334 host target protein, herein designated VGAM HOST TARGET PROTEIN. VGAM host target protein is therefore outlined by a broken line.

It is appreciated that VGAM334 host target gene, herein designated VGAM HOST TARGET GENE, in fact represents a plurality of VGAM334 host target genes. The mRNA of each one of this plurality of VGAM334 host target genes comprises one or more host target binding sites, each having a nucleotide sequence which is at least partly complementary to VGAM334 RNA, herein designated VGAM RNA, and which when bound by VGAM334 RNA, herein designated VGAM RNA, causes inhibition of translation of respective one or more VGAM334 host target proteins.

It is further appreciated by one skilled in the art that the mode of translational inhibition illustrated by FIG. 1 with specific reference to translational inhibition exerted by VGAM334 gene, herein designated VGAM GENE, on one or more VGAM334 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM334 is inhibition of expression of host target genes, as part of a novel viral mechanism of attacking a host. Accordingly, utilities of VGAM334 include diagnosis, prevention and treatment of viral infection by Vaccinia virus. Specific functions, and accordingly utilities, of VGAM334 correlate with, and may be deduced from, the identity of the host target genes which VGAM334 binds and inhibits, and the function of these host target genes, as elaborated hereinbelow.

Nucleotide sequences of the VGAM334 precursor RNA, herein designated VGAM PRECURSOR RNA, and of the diced VGAM334 RNA, herein designated VGAM RNA, and a schematic representation of the secondary folding of VGAM334 folded precursor RNA, herein designated VGAM FOLDED PRECURSOR RNA, of VGAM334 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM334 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 335 (VGAM335) viral gene, which modulates expression of respective host target genes thereof, the function and utility of which host target genes is known in the art.

VGAM335 is a novel bioinformatically detected regulatory, non protein coding, viral micro RNA (miRNA) gene. The method by which VGAM335 was detected is described hereinabove with reference to FIGS. 2-8.

VGAM335 gene, herein designated VGAM GENE, is a viral gene contained in the genome of Vaccinia virus. VGAM335 host target gene, herein designated VGAM HOST TARGET GENE, is a human gene contained in the human genome.

VGAM335 gene, herein designated VGAM GENE, encodes a VGAM335 precursor RNA, herein designated VGAM PRECURSOR RNA. Similar to other miRNA genes, and unlike most ordinary genes, VGAM335 precursor RNA, herein designated VGAM PRECURSOR RNA, does not encode a protein. A nucleotide sequence identical or highly similar to the nucleotide sequence of VGAM335 precursor RNA is designated SEQ ID:321, and is provided hereinbelow with reference to the sequence listing part. Nucleotide sequence SEQ ID:321 is located at position 190758 relative to the genome of Vaccinia virus.

VGAM335 precursor RNA, herein designated VGAM PRECURSOR RNA, folds onto itself, forming VGAM335 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM335 folded precursor RNA, herein designated VGAM FOLDED PRECURSOR RNA, into VGAM335 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 75%) nucleotide sequence of VGAM335 RNA is designated SEQ ID:670, and is provided hereinbelow with reference to the sequence listing part.

VGAM335 host target gene, herein designated VGAM HOST TARGET GENE, encodes a corresponding messenger RNA, VGAM335 host target RNA, herein designated VGAM HOST TARGET RNA. VGAM335 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM335 RNA, herein designated VGAM RNA, binds complementarily to one or more host target binding sites located in untranslated regions of VGAM335 host target RNA, herein designated VGAM HOST TARGET RNA. This complementary binding is due to the fact that the nucleotide sequence of VGAM335 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM335 RNA, herein designated VGAM RNA, may have a different number of host target binding sites in untranslated regions of a VGAM335 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM335 RNA, herein designated VGAM RNA, to host target binding sites on VGAM335 host target RNA, herein designated VGAM HOST TARGET RNA, such as BINDING SITE I, BINDING SITE II and BINDING SITE III, inhibits translation of VGAM335 host target RNA, herein designated VGAM HOST TARGET RNA, into VGAM335 host target protein, herein designated VGAM HOST TARGET PROTEIN. VGAM host target protein is therefore outlined by a broken line.

It is appreciated that VGAM335 host target gene, herein designated VGAM HOST TARGET GENE, in fact represents a plurality of VGAM335 host target genes. The mRNA of each one of this plurality of VGAM335 host target genes comprises one or more host target binding sites, each having a nucleotide sequence which is at least partly complementary to VGAM335 RNA, herein designated VGAM RNA, and which when bound by VGAM335 RNA, herein designated VGAM RNA, causes inhibition of translation of respective one or more VGAM335 host target proteins.

It is further appreciated by one skilled in the art that the mode of translational inhibition illustrated by FIG. 1 with specific reference to translational inhibition exerted by VGAM335 gene, herein designated VGAM GENE, on one or more VGAM335 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM335 is inhibition of expression of host target genes, as part of a novel viral mechanism of attacking a host. Accordingly, utilities of VGAM335 include diagnosis, prevention and treatment of viral infection by Vaccinia virus. Specific functions, and accordingly utilities, of VGAM335 correlate with, and may be deduced from, the identity of the host target genes which VGAM335 binds and inhibits, and the function of these host target genes, as elaborated hereinbelow.

Nucleotide sequences of the VGAM335 precursor RNA, herein designated VGAM PRECURSOR RNA, and of the diced VGAM335 RNA, herein designated VGAM RNA, and a schematic representation of the secondary folding of VGAM335 folded precursor RNA, herein designated VGAM FOLDED PRECURSOR RNA, of VGAM335 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM335 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 336 (VGAM336) viral gene, which modulates expression of respective host target genes thereof, the function and utility of which host target genes is known in the art.

VGAM336 is a novel bioinformatically detected regulatory, non protein coding, viral micro RNA (miRNA) gene. The method by which VGAM336 was detected is described hereinabove with reference to FIGS. 2-8.

VGAM336 gene, herein designated VGAM GENE, is a viral gene contained in the genome of Vaccinia virus. VGAM336 host target gene, herein designated VGAM HOST TARGET GENE, is a human gene contained in the human genome.

VGAM336 gene, herein designated VGAM GENE, encodes a VGAM336 precursor RNA, herein designated VGAM PRECURSOR RNA. Similar to other miRNA genes, and unlike most ordinary genes, VGAM336 precursor RNA, herein designated VGAM PRECURSOR RNA, does not encode a protein. A nucleotide sequence identical or highly similar to the nucleotide sequence of VGAM336 precursor RNA is designated SEQ ID:322, and is provided hereinbelow with reference to the sequence listing part. Nucleotide sequence SEQ ID:322 is located at position 188937 relative to the genome of Vaccinia virus.

VGAM336 precursor RNA, herein designated VGAM PRECURSOR RNA, folds onto itself, forming VGAM336 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM336 folded precursor RNA, herein designated VGAM FOLDED PRECURSOR RNA, into VGAM336 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 77%) nucleotide sequence of VGAM336 RNA is designated SEQ ID:671, and is provided hereinbelow with reference to the sequence listing part.

VGAM336 host target gene, herein designated VGAM HOST TARGET GENE, encodes a corresponding messenger RNA, VGAM336 host target RNA, herein designated VGAM HOST TARGET RNA. VGAM336 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM336 RNA, herein designated VGAM RNA, binds complementarily to one or more host target binding sites located in untranslated regions of VGAM336 host target RNA, herein designated VGAM HOST TARGET RNA. This complementary binding is due to the fact that the nucleotide sequence of VGAM336 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM336 RNA, herein designated VGAM RNA, may have a different number of host target binding sites in untranslated regions of a VGAM336 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM336 RNA, herein designated VGAM RNA, to host target binding sites on VGAM336 host target RNA, herein designated VGAM HOST TARGET RNA, such as BINDING SITE I, BINDING SITE II and BINDING SITE III, inhibits translation of VGAM336 host target RNA, herein designated VGAM HOST TARGET RNA, into VGAM336 host target protein, herein designated VGAM HOST TARGET PROTEIN. VGAM host target protein is therefore outlined by a broken line.

It is appreciated that VGAM336 host target gene, herein designated VGAM HOST TARGET GENE, in fact represents a plurality of VGAM336 host target genes. The mRNA of each one of this plurality of VGAM336 host target genes comprises one or more host target binding sites, each having a nucleotide sequence which is at least partly complementary to VGAM336 RNA, herein designated VGAM RNA, and which when bound by VGAM336 RNA, herein designated VGAM RNA, causes inhibition of translation of respective one or more VGAM336 host target proteins.

It is further appreciated by one skilled in the art that the mode of translational inhibition illustrated by FIG. 1 with specific reference to translational inhibition exerted by VGAM336 gene, herein designated VGAM GENE, on one or more VGAM336 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM336 is inhibition of expression of host target genes, as part of a novel viral mechanism of attacking a host. Accordingly, utilities of VGAM336 include diagnosis, prevention and treatment of viral infection by Vaccinia virus. Specific functions, and accordingly utilities, of VGAM336 correlate with, and may be deduced from, the identity of the host target genes which VGAM336 binds and inhibits, and the function of these host target genes, as elaborated hereinbelow.

Nucleotide sequences of the VGAM336 precursor RNA, herein designated VGAM PRECURSOR RNA, and of the diced VGAM336 RNA, herein designated VGAM RNA, and a schematic representation of the secondary folding of VGAM336 folded precursor RNA, herein designated VGAM FOLDED PRECURSOR RNA, of VGAM336 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM336 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 337 (VGAM337) viral gene, which modulates expression of respective host target genes thereof, the function and utility of which host target genes is known in the art.

VGAM337 is a novel bioinformatically detected regulatory, non protein coding, viral micro RNA (miRNA) gene. The method by which VGAM337 was detected is described hereinabove with reference to FIGS. 2-8.

VGAM337 gene, herein designated VGAM GENE, is a viral gene contained in the genome of Vaccinia virus. VGAM337 host target gene, herein designated VGAM HOST TARGET GENE, is a human gene contained in the human genome.

VGAM337 gene, herein designated VGAM GENE, encodes a VGAM337 precursor RNA, herein designated VGAM PRECURSOR RNA. Similar to other miRNA genes, and unlike most ordinary genes, VGAM337 precursor RNA, herein designated VGAM PRECURSOR RNA, does not encode a protein. A nucleotide sequence identical or highly similar to the nucleotide sequence of VGAM337 precursor RNA is designated SEQ ID:323, and is provided hereinbelow with reference to the sequence listing part. Nucleotide sequence SEQ ID:323 is located at position 187719 relative to the genome of Vaccinia virus.

VGAM337 precursor RNA, herein designated VGAM PRECURSOR RNA, folds onto itself, forming VGAM337 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM337 folded precursor RNA, herein designated VGAM FOLDED PRECURSOR RNA, into VGAM337 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 88%) nucleotide sequence of VGAM337 RNA is designated SEQ ID:672, and is provided hereinbelow with reference to the sequence listing part.

VGAM337 host target gene, herein designated VGAM HOST TARGET GENE, encodes a corresponding messenger RNA, VGAM337 host target RNA, herein designated VGAM HOST TARGET RNA. VGAM337 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM337 RNA, herein designated VGAM RNA, binds complementarily to one or more host target binding sites located in untranslated regions of VGAM337 host target RNA, herein designated VGAM HOST TARGET RNA. This complementary binding is due to the fact that the nucleotide sequence of VGAM337 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM337 RNA, herein designated VGAM RNA, may have a different number of host target binding sites in untranslated regions of a VGAM337 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM337 RNA, herein designated VGAM RNA, to host target binding sites on VGAM337 host target RNA, herein designated VGAM HOST TARGET RNA, such as BINDING SITE I, BINDING SITE II and BINDING SITE III, inhibits translation of VGAM337 host target RNA, herein designated VGAM HOST TARGET RNA, into VGAM337 host target protein, herein designated VGAM HOST TARGET PROTEIN. VGAM host target protein is therefore outlined by a broken line.

It is appreciated that VGAM337 host target gene, herein designated VGAM HOST TARGET GENE, in fact represents a plurality of VGAM337 host target genes. The mRNA of each one of this plurality of VGAM337 host target genes comprises one or more host target binding sites, each having a nucleotide sequence which is at least partly complementary to VGAM337 RNA, herein designated VGAM RNA, and which when bound by VGAM337 RNA, herein designated VGAM RNA, causes inhibition of translation of respective one or more VGAM337 host target proteins.

It is further appreciated by one skilled in the art that the mode of translational inhibition illustrated by FIG. 1 with specific reference to translational inhibition exerted by VGAM337 gene, herein designated VGAM GENE, on one or more VGAM337 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM337 is inhibition of expression of host target genes, as part of a novel viral mechanism of attacking a host. Accordingly, utilities of VGAM337 include diagnosis, prevention and treatment of viral infection by Vaccinia virus. Specific functions, and accordingly utilities, of VGAM337 correlate with, and may be deduced from, the identity of the host target genes which VGAM337 binds and inhibits, and the function of these host target genes, as elaborated hereinbelow.

Nucleotide sequences of the VGAM337 precursor RNA, herein designated VGAM PRECURSOR RNA, and of the diced VGAM337 RNA, herein designated VGAM RNA, and a schematic representation of the secondary folding of VGAM337 folded precursor RNA, herein designated VGAM FOLDED PRECURSOR RNA, of VGAM337 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM337 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 338 (VGAM338) viral gene, which modulates expression of respective host target genes thereof, the function and utility of which host target genes is known in the art.

VGAM338 is a novel bioinformatically detected regulatory, non protein coding, viral micro RNA (miRNA) gene. The method by which VGAM338 was detected is described hereinabove with reference to FIGS. 2-8.

VGAM338 gene, herein designated VGAM GENE, is a viral gene contained in the genome of Vaccinia virus. VGAM338 host target gene, herein designated VGAM HOST TARGET GENE, is a human gene contained in the human genome.

VGAM338 gene, herein designated VGAM GENE, encodes a VGAM338 precursor RNA, herein designated VGAM PRECURSOR RNA. Similar to other miRNA genes, and unlike most ordinary genes, VGAM338 precursor RNA, herein designated VGAM PRECURSOR RNA, does not encode a protein. A nucleotide sequence identical or highly similar to the nucleotide sequence of VGAM338 precursor RNA is designated SEQ ID:324, and is provided hereinbelow with reference to the sequence listing part. Nucleotide sequence SEQ ID:324 is located at position 188420 relative to the genome of Vaccinia virus.

VGAM338 precursor RNA, herein designated VGAM PRECURSOR RNA, folds onto itself, forming VGAM338 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM338 folded precursor RNA, herein designated VGAM FOLDED PRECURSOR RNA, into VGAM338 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM338 RNA is designated SEQ ID:673, and is provided hereinbelow with reference to the sequence listing part.

VGAM338 host target gene, herein designated VGAM HOST TARGET GENE, encodes a corresponding messenger RNA, VGAM338 host target RNA, herein designated VGAM HOST TARGET RNA. VGAM338 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM338 RNA, herein designated VGAM RNA, binds complementarily to one or more host target binding sites located in untranslated regions of VGAM338 host target RNA, herein designated VGAM HOST TARGET RNA. This complementary binding is due to the fact that the nucleotide sequence of VGAM338 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM338 RNA, herein designated VGAM RNA, may have a different number of host target binding sites in untranslated regions of a VGAM338 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM338 RNA, herein designated VGAM RNA, to host target binding sites on VGAM338 host target RNA, herein designated VGAM HOST TARGET RNA, such as BINDING SITE I, BINDING SITE II and BINDING SITE III, inhibits translation of VGAM338 host target RNA, herein designated VGAM HOST TARGET RNA, into VGAM338 host target protein, herein designated VGAM HOST TARGET PROTEIN. VGAM host target protein is therefore outlined by a broken line.

It is appreciated that VGAM338 host target gene, herein designated VGAM HOST TARGET GENE, in fact represents a plurality of VGAM338 host target genes. The mRNA of each one of this plurality of VGAM338 host target genes comprises one or more host target binding sites, each having a nucleotide sequence which is at least partly complementary to VGAM338 RNA, herein designated VGAM RNA, and which when bound by VGAM338 RNA, herein designated VGAM RNA, causes inhibition of translation of respective one or more VGAM338 host target proteins.

It is further appreciated by one skilled in the art that the mode of translational inhibition illustrated by FIG. 1 with specific reference to translational inhibition exerted by VGAM338 gene, herein designated VGAM GENE, on one or more VGAM338 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM338 is inhibition of expression of host target genes, as part of a novel viral mechanism of attacking a host. Accordingly, utilities of VGAM338 include diagnosis, prevention and treatment of viral infection by Vaccinia virus. Specific functions, and accordingly utilities, of VGAM338 correlate with, and may be deduced from, the identity of the host target genes which VGAM338 binds and inhibits, and the function of these host target genes, as elaborated hereinbelow.

Nucleotide sequences of the VGAM338 precursor RNA, herein designated VGAM PRECURSOR RNA, and of the diced VGAM338 RNA, herein designated VGAM RNA, and a schematic representation of the secondary folding of VGAM338 folded precursor RNA, herein designated VGAM FOLDED PRECURSOR RNA, of VGAM338 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM338 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 339 (VGAM339) viral gene, which modulates expression of respective host target genes thereof, the function and utility of which host target genes is known in the art.

VGAM339 is a novel bioinformatically detected regulatory, non protein coding, viral micro RNA (miRNA) gene. The method by which VGAM339 was detected is described hereinabove with reference to FIGS. 2-8.

VGAM339 gene, herein designated VGAM GENE, is a viral gene contained in the genome of Vaccinia virus. VGAM339 host target gene, herein designated VGAM HOST TARGET GENE, is a human gene contained in the human genome.

VGAM339 gene, herein designated VGAM GENE, encodes a VGAM339 precursor RNA, herein designated VGAM PRECURSOR RNA. Similar to other miRNA genes, and unlike most ordinary genes, VGAM339 precursor RNA, herein designated VGAM PRECURSOR RNA, does not encode a protein. A nucleotide sequence identical or highly similar to the nucleotide sequence of VGAM339 precursor RNA is designated SEQ ID:325, and is provided hereinbelow with reference to the sequence listing part. Nucleotide sequence SEQ ID:325 is located at position 190813 relative to the genome of Vaccinia virus.

VGAM339 precursor RNA, herein designated VGAM PRECURSOR RNA, folds onto itself, forming VGAM339 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM339 folded precursor RNA, herein designated VGAM FOLDED PRECURSOR RNA, into VGAM339 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 82%) nucleotide sequence of VGAM339 RNA is designated SEQ ID:674, and is provided hereinbelow with reference to the sequence listing part.

VGAM339 host target gene, herein designated VGAM HOST TARGET GENE, encodes a corresponding messenger RNA, VGAM339 host target RNA, herein designated VGAM HOST TARGET RNA. VGAM339 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM339 RNA, herein designated VGAM RNA, binds complementarily to one or more host target binding sites located in untranslated regions of VGAM339 host target RNA, herein designated VGAM HOST TARGET RNA. This complementary binding is due to the fact that the nucleotide sequence of VGAM339 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM339 RNA, herein designated VGAM RNA, may have a different number of host target binding sites in untranslated regions of a VGAM339 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM339 RNA, herein designated VGAM RNA, to host target binding sites on VGAM339 host target RNA, herein designated VGAM HOST TARGET RNA, such as BINDING SITE I, BINDING SITE II and BINDING SITE III, inhibits translation of VGAM339 host target RNA, herein designated VGAM HOST TARGET RNA, into VGAM339 host target protein, herein designated VGAM HOST TARGET PROTEIN. VGAM host target protein is therefore outlined by a broken line.

It is appreciated that VGAM339 host target gene, herein designated VGAM HOST TARGET GENE, in fact represents a plurality of VGAM339 host target genes. The mRNA of each one of this plurality of VGAM339 host target genes comprises one or more host target binding sites, each having a nucleotide sequence which is at least partly complementary to VGAM339 RNA, herein designated VGAM RNA, and which when bound by VGAM339 RNA, herein designated VGAM RNA, causes inhibition of translation of respective one or more VGAM339 host target proteins.

It is further appreciated by one skilled in the art that the mode of translational inhibition illustrated by FIG. 1 with specific reference to translational inhibition exerted by VGAM339 gene, herein designated VGAM GENE, on one or more VGAM339 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM339 is inhibition of expression of host target genes, as part of a novel viral mechanism of attacking a host. Accordingly, utilities of VGAM339 include diagnosis, prevention and treatment of viral infection by Vaccinia virus. Specific functions, and accordingly utilities, of VGAM339 correlate with, and may be deduced from, the identity of the host target genes which VGAM339 binds and inhibits, and the function of these host target genes, as elaborated hereinbelow.

Nucleotide sequences of the VGAM339 precursor RNA, herein designated VGAM PRECURSOR RNA, and of the diced VGAM339 RNA, herein designated VGAM RNA, and a schematic representation of the secondary folding of VGAM339 folded precursor RNA, herein designated VGAM FOLDED PRECURSOR RNA, of VGAM339 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM339 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 340 (VGAM340) viral gene, which modulates expression of respective host target genes thereof, the function and utility of which host target genes is known in the art.

VGAM340 is a novel bioinformatically detected regulatory, non protein coding, viral micro RNA (miRNA) gene. The method by which VGAM340 was detected is described hereinabove with reference to FIGS. 2-8.

VGAM340 gene, herein designated VGAM GENE, is a viral gene contained in the genome of Vaccinia virus. VGAM340 host target gene, herein designated VGAM HOST TARGET GENE, is a human gene contained in the human genome.

VGAM340 gene, herein designated VGAM GENE, encodes a VGAM340 precursor RNA, herein designated VGAM PRECURSOR RNA. Similar to other miRNA genes, and unlike most ordinary genes, VGAM340 precursor RNA, herein designated VGAM PRECURSOR RNA, does not encode a protein. A nucleotide sequence identical or highly similar to the nucleotide sequence of VGAM340 precursor RNA is designated SEQ ID:326, and is provided hereinbelow with reference to the sequence listing part. Nucleotide sequence SEQ ID:326 is located at position 188778 relative to the genome of Vaccinia virus.

VGAM340 precursor RNA, herein designated VGAM PRECURSOR RNA, folds onto itself, forming VGAM340 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM340 folded precursor RNA, herein designated VGAM FOLDED PRECURSOR RNA, into VGAM340 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 90%) nucleotide sequence of VGAM340 RNA is designated SEQ ID:675, and is provided hereinbelow with reference to the sequence listing part.

VGAM340 host target gene, herein designated VGAM HOST TARGET GENE, encodes a corresponding messenger RNA, VGAM340 host target RNA, herein designated VGAM HOST TARGET RNA. VGAM340 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM340 RNA, herein designated VGAM RNA, binds complementarily to one or more host target binding sites located in untranslated regions of VGAM340 host target RNA, herein designated VGAM HOST TARGET RNA. This complementary binding is due to the fact that the nucleotide sequence of VGAM340 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM340 RNA, herein designated VGAM RNA, may have a different number of host target binding sites in untranslated regions of a VGAM340 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM340 RNA, herein designated VGAM RNA, to host target binding sites on VGAM340 host target RNA, herein designated VGAM HOST TARGET RNA, such as BINDING SITE I, BINDING SITE II and BINDING SITE III, inhibits translation of VGAM340 host target RNA, herein designated VGAM HOST TARGET RNA, into VGAM340 host target protein, herein designated VGAM HOST TARGET PROTEIN. VGAM host target protein is therefore outlined by a broken line.

It is appreciated that VGAM340 host target gene, herein designated VGAM HOST TARGET GENE, in fact represents a plurality of VGAM340 host target genes. The mRNA of each one of this plurality of VGAM340 host target genes comprises one or more host target binding sites, each having a nucleotide sequence which is at least partly complementary to VGAM340 RNA, herein designated VGAM RNA, and which when bound by VGAM340 RNA, herein designated VGAM RNA, causes inhibition of translation of respective one or more VGAM340 host target proteins.

It is further appreciated by one skilled in the art that the mode of translational inhibition illustrated by FIG. 1 with specific reference to translational inhibition exerted by VGAM340 gene, herein designated VGAM GENE, on one or more VGAM340 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM340 is inhibition of expression of host target genes, as part of a novel viral mechanism of attacking a host. Accordingly, utilities of VGAM340 include diagnosis, prevention and treatment of viral infection by Vaccinia virus. Specific functions, and accordingly utilities, of VGAM340 correlate with, and may be deduced from, the identity of the host target genes which VGAM340 binds and inhibits, and the function of these host target genes, as elaborated hereinbelow.

Nucleotide sequences of the VGAM340 precursor RNA, herein designated VGAM PRECURSOR RNA, and of the diced VGAM340 RNA, herein designated VGAM RNA, and a schematic representation of the secondary folding of VGAM340 folded precursor RNA, herein designated VGAM FOLDED PRECURSOR RNA, of VGAM340 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM340 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 341 (VGAM341) viral gene, which modulates expression of respective host target genes thereof, the function and utility of which host target genes is known in the art.

VGAM341 is a novel bioinformatically detected regulatory, non protein coding, viral micro RNA (miRNA) gene. The method by which VGAM341 was detected is described hereinabove with reference to FIGS. 2-8.

VGAM341 gene, herein designated VGAM GENE, is a viral gene contained in the genome of Vaccinia virus. VGAM341 host target gene, herein designated VGAM HOST TARGET GENE, is a human gene contained in the human genome.

VGAM341 gene, herein designated VGAM GENE, encodes a VGAM341 precursor RNA, herein designated VGAM PRECURSOR RNA. Similar to other miRNA genes, and unlike most ordinary genes, VGAM341 precursor RNA, herein designated VGAM PRECURSOR RNA, does not encode a protein. A nucleotide sequence identical or highly similar to the nucleotide sequence of VGAM341 precursor RNA is designated SEQ ID:327, and is provided hereinbelow with reference to the sequence listing part. Nucleotide sequence SEQ ID:327 is located at position 642 relative to the genome of Vaccinia virus.

VGAM341 precursor RNA, herein designated VGAM PRECURSOR RNA, folds onto itself, forming VGAM341 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM341 folded precursor RNA, herein designated VGAM FOLDED PRECURSOR RNA, into VGAM341 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM341 RNA is designated SEQ ID:676, and is provided hereinbelow with reference to the sequence listing part.

VGAM341 host target gene, herein designated VGAM HOST TARGET GENE, encodes a corresponding messenger RNA, VGAM341 host target RNA, herein designated VGAM HOST TARGET RNA. VGAM341 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM341 RNA, herein designated VGAM RNA, binds complementarily to one or more host target binding sites located in untranslated regions of VGAM341 host target RNA, herein designated VGAM HOST TARGET RNA. This complementary binding is due to the fact that the nucleotide sequence of VGAM341 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM341 RNA, herein designated VGAM RNA, may have a different number of host target binding sites in untranslated regions of a VGAM341 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM341 RNA, herein designated VGAM RNA, to host target binding sites on VGAM341 host target RNA, herein designated VGAM HOST TARGET RNA, such as BINDING SITE I, BINDING SITE II and BINDING SITE III, inhibits translation of VGAM341 host target RNA, herein designated VGAM HOST TARGET RNA, into VGAM341 host target protein, herein designated VGAM HOST TARGET PROTEIN. VGAM host target protein is therefore outlined by a broken line.

It is appreciated that VGAM341 host target gene, herein designated VGAM HOST TARGET GENE, in fact represents a plurality of VGAM341 host target genes. The mRNA of each one of this plurality of VGAM341 host target genes comprises one or more host target binding sites, each having a nucleotide sequence which is at least partly complementary to VGAM341 RNA, herein designated VGAM RNA, and which when bound by VGAM341 RNA, herein designated VGAM RNA, causes inhibition of translation of respective one or more VGAM341 host target proteins.

It is further appreciated by one skilled in the art that the mode of translational inhibition illustrated by FIG. 1 with specific reference to translational inhibition exerted by VGAM341 gene, herein designated VGAM GENE, on one or more VGAM341 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM341 is inhibition of expression of host target genes, as part of a novel viral mechanism of attacking a host. Accordingly, utilities of VGAM341 include diagnosis, prevention and treatment of viral infection by Vaccinia virus. Specific functions, and accordingly utilities, of VGAM341 correlate with, and may be deduced from, the identity of the host target genes which VGAM341 binds and inhibits, and the function of these host target genes, as elaborated hereinbelow.

Nucleotide sequences of the VGAM341 precursor RNA, herein designated VGAM PRECURSOR RNA, and of the diced VGAM341 RNA, herein designated VGAM RNA, and a schematic representation of the secondary folding of VGAM341 folded precursor RNA, herein designated VGAM FOLDED PRECURSOR RNA, of VGAM341 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM341 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 342 (VGAM342) viral gene, which modulates expression of respective host target genes thereof, the function and utility of which host target genes is known in the art.

VGAM342 is a novel bioinformatically detected regulatory, non protein coding, viral micro RNA (miRNA) gene. The method by which VGAM342 was detected is described hereinabove with reference to FIGS. 2-8.

VGAM342 gene, herein designated VGAM GENE, is a viral gene contained in the genome of Vaccinia virus. VGAM342 host target gene, herein designated VGAM HOST TARGET GENE, is a human gene contained in the human genome.

VGAM342 gene, herein designated VGAM GENE, encodes a VGAM342 precursor RNA, herein designated VGAM PRECURSOR RNA. Similar to other miRNA genes, and unlike most ordinary genes, VGAM342 precursor RNA, herein designated VGAM PRECURSOR RNA, does not encode a protein. A nucleotide sequence identical or highly similar to the nucleotide sequence of VGAM342 precursor RNA is designated SEQ ID:328, and is provided hereinbelow with reference to the sequence listing part. Nucleotide sequence SEQ ID:328 is located at position 3549 relative to the genome of Vaccinia virus.

VGAM342 precursor RNA, herein designated VGAM PRECURSOR RNA, folds onto itself, forming VGAM342 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM342 folded precursor RNA, herein designated VGAM FOLDED PRECURSOR RNA, into VGAM342 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 74%) nucleotide sequence of VGAM342 RNA is designated SEQ ID:677, and is provided hereinbelow with reference to the sequence listing part.

VGAM342 host target gene, herein designated VGAM HOST TARGET GENE, encodes a corresponding messenger RNA, VGAM342 host target RNA, herein designated VGAM HOST TARGET RNA. VGAM342 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM342 RNA, herein designated VGAM RNA, binds complementarily to one or more host target binding sites located in untranslated regions of VGAM342 host target RNA, herein designated VGAM HOST TARGET RNA. This complementary binding is due to the fact that the nucleotide sequence of VGAM342 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM342 RNA, herein designated VGAM RNA, may have a different number of host target binding sites in untranslated regions of a VGAM342 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM342 RNA, herein designated VGAM RNA, to host target binding sites on VGAM342 host target RNA, herein designated VGAM HOST TARGET RNA, such as BINDING SITE I, BINDING SITE II and BINDING SITE III, inhibits translation of VGAM342 host target RNA, herein designated VGAM HOST TARGET RNA, into VGAM342 host target protein, herein designated VGAM HOST TARGET PROTEIN. VGAM host target protein is therefore outlined by a broken line.

It is appreciated that VGAM342 host target gene, herein designated VGAM HOST TARGET GENE, in fact represents a plurality of VGAM342 host target genes. The mRNA of each one of this plurality of VGAM342 host target genes comprises one or more host target binding sites, each having a nucleotide sequence which is at least partly complementary to VGAM342 RNA, herein designated VGAM RNA, and which when bound by VGAM342 RNA, herein designated VGAM RNA, causes inhibition of translation of respective one or more VGAM342 host target proteins.

It is further appreciated by one skilled in the art that the mode of translational inhibition illustrated by FIG. 1 with specific reference to translational inhibition exerted by VGAM342 gene, herein designated VGAM GENE, on one or more VGAM342 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM342 is inhibition of expression of host target genes, as part of a novel viral mechanism of attacking a host. Accordingly, utilities of VGAM342 include diagnosis, prevention and treatment of viral infection by Vaccinia virus. Specific functions, and accordingly utilities, of VGAM342 correlate with, and may be deduced from, the identity of the host target genes which VGAM342 binds and inhibits, and the function of these host target genes, as elaborated hereinbelow.

Nucleotide sequences of the VGAM342 precursor RNA, herein designated VGAM PRECURSOR RNA, and of the diced VGAM342 RNA, herein designated VGAM RNA, and a schematic representation of the secondary folding of VGAM342 folded precursor RNA, herein designated VGAM FOLDED PRECURSOR RNA, of VGAM342 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM342 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 343 (VGAM343) viral gene, which modulates expression of respective host target genes thereof, the function and utility of which host target genes is known in the art.

VGAM343 is a novel bioinformatically detected regulatory, non protein coding, viral micro RNA (miRNA) gene. The method by which VGAM343 was detected is described hereinabove with reference to FIGS. 2-8.

VGAM343 gene, herein designated VGAM GENE, is a viral gene contained in the genome of Vaccinia virus. VGAM343 host target gene, herein designated VGAM HOST TARGET GENE, is a human gene contained in the human genome.

VGAM343 gene, herein designated VGAM GENE, encodes a VGAM343 precursor RNA, herein designated VGAM PRECURSOR RNA. Similar to other miRNA genes, and unlike most ordinary genes, VGAM343 precursor RNA, herein designated VGAM PRECURSOR RNA, does not encode a protein. A nucleotide sequence identical or highly similar to the nucleotide sequence of VGAM343 precursor RNA is designated SEQ ID:329, and is provided hereinbelow with reference to the sequence listing part. Nucleotide sequence SEQ ID:329 is located at position 3549 relative to the genome of Vaccinia virus.

VGAM343 precursor RNA, herein designated VGAM PRECURSOR RNA, folds onto itself, forming VGAM343 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM343 folded precursor RNA, herein designated VGAM FOLDED PRECURSOR RNA, into VGAM343 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 74%) nucleotide sequence of VGAM343 RNA is designated SEQ ID:678, and is provided hereinbelow with reference to the sequence listing part.

VGAM343 host target gene, herein designated VGAM HOST TARGET GENE, encodes a corresponding messenger RNA, VGAM343 host target RNA, herein designated VGAM HOST TARGET RNA. VGAM343 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM343 RNA, herein designated VGAM RNA, binds complementarily to one or more host target binding sites located in untranslated regions of VGAM343 host target RNA, herein designated VGAM HOST TARGET RNA. This complementary binding is due to the fact that the nucleotide sequence of VGAM343 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM343 RNA, herein designated VGAM RNA, may have a different number of host target binding sites in untranslated regions of a VGAM343 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM343 RNA, herein designated VGAM RNA, to host target binding sites on VGAM343 host target RNA, herein designated VGAM HOST TARGET RNA, such as BINDING SITE I, BINDING SITE II and BINDING SITE III, inhibits translation of VGAM343 host target RNA, herein designated VGAM HOST TARGET RNA, into VGAM343 host target protein, herein designated VGAM HOST TARGET PROTEIN. VGAM host target protein is therefore outlined by a broken line.

It is appreciated that VGAM343 host target gene, herein designated VGAM HOST TARGET GENE, in fact represents a plurality of VGAM343 host target genes. The mRNA of each one of this plurality of VGAM343 host target genes comprises one or more host target binding sites, each having a nucleotide sequence which is at least partly complementary to VGAM343 RNA, herein designated VGAM RNA, and which when bound by VGAM343 RNA, herein designated VGAM RNA, causes inhibition of translation of respective one or more VGAM343 host target proteins.

It is further appreciated by one skilled in the art that the mode of translational inhibition illustrated by FIG. 1 with specific reference to translational inhibition exerted by VGAM343 gene, herein designated VGAM GENE, on one or more VGAM343 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM343 is inhibition of expression of host target genes, as part of a novel viral mechanism of attacking a host. Accordingly, utilities of VGAM343 include diagnosis, prevention and treatment of viral infection by Vaccinia virus. Specific functions, and accordingly utilities, of VGAM343 correlate with, and may be deduced from, the identity of the host target genes which VGAM343 binds and inhibits, and the function of these host target genes, as elaborated hereinbelow.

Nucleotide sequences of the VGAM343 precursor RNA, herein designated VGAM PRECURSOR RNA, and of the diced VGAM343 RNA, herein designated VGAM RNA, and a schematic representation of the secondary folding of VGAM343 folded precursor RNA, herein designated VGAM FOLDED PRECURSOR RNA, of VGAM343 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM343 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 344 (VGAM344) viral gene, which modulates expression of respective host target genes thereof, the function and utility of which host target genes is known in the art.

VGAM344 is a novel bioinformatically detected regulatory, non protein coding, viral micro RNA (miRNA) gene. The method by which VGAM344 was detected is described hereinabove with reference to FIGS. 2-8.

VGAM344 gene, herein designated VGAM GENE, is a viral gene contained in the genome of Vaccinia virus. VGAM344 host target gene, herein designated VGAM HOST TARGET GENE, is a human gene contained in the human genome.

VGAM344 gene, herein designated VGAM GENE, encodes a VGAM344 precursor RNA, herein designated VGAM PRECURSOR RNA. Similar to other miRNA genes, and unlike most ordinary genes, VGAM344 precursor RNA, herein designated VGAM PRECURSOR RNA, does not encode a protein. A nucleotide sequence identical or highly similar to the nucleotide sequence of VGAM344 precursor RNA is designated SEQ ID:330, and is provided hereinbelow with reference to the sequence listing part. Nucleotide sequence SEQ ID:330 is located at position 2981 relative to the genome of Vaccinia virus.

VGAM344 precursor RNA, herein designated VGAM PRECURSOR RNA, folds onto itself, forming VGAM344 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM344 folded precursor RNA, herein designated VGAM FOLDED PRECURSOR RNA, into VGAM344 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 79%) nucleotide sequence of VGAM344 RNA is designated SEQ ID:679, and is provided hereinbelow with reference to the sequence listing part.

VGAM344 host target gene, herein designated VGAM HOST TARGET GENE, encodes a corresponding messenger RNA, VGAM344 host target RNA, herein designated VGAM HOST TARGET RNA. VGAM344 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM344 RNA, herein designated VGAM RNA, binds complementarily to one or more host target binding sites located in untranslated regions of VGAM344 host target RNA, herein designated VGAM HOST TARGET RNA. This complementary binding is due to the fact that the nucleotide sequence of VGAM344 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM344 RNA, herein designated VGAM RNA, may have a different number of host target binding sites in untranslated regions of a VGAM344 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM344 RNA, herein designated VGAM RNA, to host target binding sites on VGAM344 host target RNA, herein designated VGAM HOST TARGET RNA, such as BINDING SITE I, BINDING SITE II and BINDING SITE III, inhibits translation of VGAM344 host target RNA, herein designated VGAM HOST TARGET RNA, into VGAM344 host target protein, herein designated VGAM HOST TARGET PROTEIN. VGAM host target protein is therefore outlined by a broken line.

It is appreciated that VGAM344 host target gene, herein designated VGAM HOST TARGET GENE, in fact represents a plurality of VGAM344 host target genes. The mRNA of each one of this plurality of VGAM344 host target genes comprises one or more host target binding sites, each having a nucleotide sequence which is at least partly complementary to VGAM344 RNA, herein designated VGAM RNA, and which when bound by VGAM344 RNA, herein designated VGAM RNA, causes inhibition of translation of respective one or more VGAM344 host target proteins.

It is further appreciated by one skilled in the art that the mode of translational inhibition illustrated by FIG. 1 with specific reference to translational inhibition exerted by VGAM344 gene, herein designated VGAM GENE, on one or more VGAM344 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM344 is inhibition of expression of host target genes, as part of a novel viral mechanism of attacking a host. Accordingly, utilities of VGAM344 include diagnosis, prevention and treatment of viral infection by Vaccinia virus. Specific functions, and accordingly utilities, of VGAM344 correlate with, and may be deduced from, the identity of the host target genes which VGAM344 binds and inhibits, and the function of these host target genes, as elaborated hereinbelow.

Nucleotide sequences of the VGAM344 precursor RNA, herein designated VGAM PRECURSOR RNA, and of the diced VGAM344 RNA, herein designated VGAM RNA, and a schematic representation of the secondary folding of VGAM344 folded precursor RNA, herein designated VGAM FOLDED PRECURSOR RNA, of VGAM344 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM344 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 345 (VGAM345) viral gene, which modulates expression of respective host target genes thereof, the function and utility of which host target genes is known in the art.

VGAM345 is a novel bioinformatically detected regulatory, non protein coding, viral micro RNA (miRNA) gene. The method by which VGAM345 was detected is described hereinabove with reference to FIGS. 2-8.

VGAM345 gene, herein designated VGAM GENE, is a viral gene contained in the genome of Vaccinia virus. VGAM345 host target gene, herein designated VGAM HOST TARGET GENE, is a human gene contained in the human genome.

VGAM345 gene, herein designated VGAM GENE, encodes a VGAM345 precursor RNA, herein designated VGAM PRECURSOR RNA. Similar to other miRNA genes, and unlike most ordinary genes, VGAM345 precursor RNA, herein designated VGAM PRECURSOR RNA, does not encode a protein. A nucleotide sequence identical or highly similar to the nucleotide sequence of VGAM345 precursor RNA is designated SEQ ID:331, and is provided hereinbelow with reference to the sequence listing part. Nucleotide sequence SEQ ID:331 is located at position 963 relative to the genome of Vaccinia virus.

VGAM345 precursor RNA, herein designated VGAM PRECURSOR RNA, folds onto itself, forming VGAM345 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM345 folded precursor RNA, herein designated VGAM FOLDED PRECURSOR RNA, into VGAM345 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM345 RNA is designated SEQ ID:680, and is provided hereinbelow with reference to the sequence listing part.

VGAM345 host target gene, herein designated VGAM HOST TARGET GENE, encodes a corresponding messenger RNA, VGAM345 host target RNA, herein designated VGAM HOST TARGET RNA. VGAM345 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM345 RNA, herein designated VGAM RNA, binds complementarily to one or more host target binding sites located in untranslated regions of VGAM345 host target RNA, herein designated VGAM HOST TARGET RNA. This complementary binding is due to the fact that the nucleotide sequence of VGAM345 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM345 RNA, herein designated VGAM RNA, may have a different number of host target binding sites in untranslated regions of a VGAM345 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM345 RNA, herein designated VGAM RNA, to host target binding sites on VGAM345 host target RNA, herein designated VGAM HOST TARGET RNA, such as BINDING SITE I, BINDING SITE II and BINDING SITE III, inhibits translation of VGAM345 host target RNA, herein designated VGAM HOST TARGET RNA, into VGAM345 host target protein, herein designated VGAM HOST TARGET PROTEIN. VGAM host target protein is therefore outlined by a broken line.

It is appreciated that VGAM345 host target gene, herein designated VGAM HOST TARGET GENE, in fact represents a plurality of VGAM345 host target genes. The mRNA of each one of this plurality of VGAM345 host target genes comprises one or more host target binding sites, each having a nucleotide sequence which is at least partly complementary to VGAM345 RNA, herein designated VGAM RNA, and which when bound by VGAM345 RNA, herein designated VGAM RNA, causes inhibition of translation of respective one or more VGAM345 host target proteins.

It is further appreciated by one skilled in the art that the mode of translational inhibition illustrated by FIG. 1 with specific reference to translational inhibition exerted by VGAM345 gene, herein designated VGAM GENE, on one or more VGAM345 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM345 is inhibition of expression of host target genes, as part of a novel viral mechanism of attacking a host. Accordingly, utilities of VGAM345 include diagnosis, prevention and treatment of viral infection by Vaccinia virus. Specific functions, and accordingly utilities, of VGAM345 correlate with, and may be deduced from, the identity of the host target genes which VGAM345 binds and inhibits, and the function of these host target genes, as elaborated hereinbelow.

Nucleotide sequences of the VGAM345 precursor RNA, herein designated VGAM PRECURSOR RNA, and of the diced VGAM345 RNA, herein designated VGAM RNA, and a schematic representation of the secondary folding of VGAM345 folded precursor RNA, herein designated VGAM FOLDED PRECURSOR RNA, of VGAM345 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM345 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 346 (VGAM346) viral gene, which modulates expression of respective host target genes thereof, the function and utility of which host target genes is known in the art.

VGAM346 is a novel bioinformatically detected regulatory, non protein coding, viral micro RNA (miRNA) gene. The method by which VGAM346 was detected is described hereinabove with reference to FIGS. 2-8.

VGAM346 gene, herein designated VGAM GENE, is a viral gene contained in the genome of Vaccinia virus. VGAM346 host target gene, herein designated VGAM HOST TARGET GENE, is a human gene contained in the human genome.

VGAM346 gene, herein designated VGAM GENE, encodes a VGAM346 precursor RNA, herein designated VGAM PRECURSOR RNA. Similar to other miRNA genes, and unlike most ordinary genes, VGAM346 precursor RNA, herein designated VGAM PRECURSOR RNA, does not encode a protein. A nucleotide sequence identical or highly similar to the nucleotide sequence of VGAM346 precursor RNA is designated SEQ ID:332, and is provided hereinbelow with reference to the sequence listing part. Nucleotide sequence SEQ ID:332 is located at position 963 relative to the genome of Vaccinia virus.

VGAM346 precursor RNA, herein designated VGAM PRECURSOR RNA, folds onto itself, forming VGAM346 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM346 folded precursor RNA, herein designated VGAM FOLDED PRECURSOR RNA, into VGAM346 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM346 RNA is designated SEQ ID:681, and is provided hereinbelow with reference to the sequence listing part.

VGAM346 host target gene, herein designated VGAM HOST TARGET GENE, encodes a corresponding messenger RNA, VGAM346 host target RNA, herein designated VGAM HOST TARGET RNA. VGAM346 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM346 RNA, herein designated VGAM RNA, binds complementarily to one or more host target binding sites located in untranslated regions of VGAM346 host target RNA, herein designated VGAM HOST TARGET RNA. This complementary binding is due to the fact that the nucleotide sequence of VGAM346 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM346 RNA, herein designated VGAM RNA, may have a different number of host target binding sites in untranslated regions of a VGAM346 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM346 RNA, herein designated VGAM RNA, to host target binding sites on VGAM346 host target RNA, herein designated VGAM HOST TARGET RNA, such as BINDING SITE I, BINDING SITE II and BINDING SITE III, inhibits translation of VGAM346 host target RNA, herein designated VGAM HOST TARGET RNA, into VGAM346 host target protein, herein designated VGAM HOST TARGET PROTEIN. VGAM host target protein is therefore outlined by a broken line.

It is appreciated that VGAM346 host target gene, herein designated VGAM HOST TARGET GENE, in fact represents a plurality of VGAM346 host target genes. The mRNA of each one of this plurality of VGAM346 host target genes comprises one or more host target binding sites, each having a nucleotide sequence which is at least partly complementary to VGAM346 RNA, herein designated VGAM RNA, and which when bound by VGAM346 RNA, herein designated VGAM RNA, causes inhibition of translation of respective one or more VGAM346 host target proteins.

It is further appreciated by one skilled in the art that the mode of translational inhibition illustrated by FIG. 1 with specific reference to translational inhibition exerted by VGAM346 gene, herein designated VGAM GENE, on one or more VGAM346 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM346 is inhibition of expression of host target genes, as part of a novel viral mechanism of attacking a host. Accordingly, utilities of VGAM346 include diagnosis, prevention and treatment of viral infection by Vaccinia virus. Specific functions, and accordingly utilities, of VGAM346 correlate with, and may be deduced from, the identity of the host target genes which VGAM346 binds and inhibits, and the function of these host target genes, as elaborated hereinbelow.

Nucleotide sequences of the VGAM346 precursor RNA, herein designated VGAM PRECURSOR RNA, and of the diced VGAM346 RNA, herein designated VGAM RNA, and a schematic representation of the secondary folding of VGAM346 folded precursor RNA, herein designated VGAM FOLDED PRECURSOR RNA, of VGAM346 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM346 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 347 (VGAM347) viral gene, which modulates expression of respective host target genes thereof, the function and utility of which host target genes is known in the art.

VGAM347 is a novel bioinformatically detected regulatory, non protein coding, viral micro RNA (miRNA) gene. The method by which VGAM347 was detected is described hereinabove with reference to FIGS. 2-8.

VGAM347 gene, herein designated VGAM GENE, is a viral gene contained in the genome of Vaccinia virus. VGAM347 host target gene, herein designated VGAM HOST TARGET GENE, is a human gene contained in the human genome.

VGAM347 gene, herein designated VGAM GENE, encodes a VGAM347 precursor RNA, herein designated VGAM PRECURSOR RNA. Similar to other miRNA genes, and unlike most ordinary genes, VGAM347 precursor RNA, herein designated VGAM PRECURSOR RNA, does not encode a protein. A nucleotide sequence identical or highly similar to the nucleotide sequence of VGAM347 precursor RNA is designated SEQ ID:333, and is provided hereinbelow with reference to the sequence listing part. Nucleotide sequence SEQ ID:333 is located at position 963 relative to the genome of Vaccinia virus.

VGAM347 precursor RNA, herein designated VGAM PRECURSOR RNA, folds onto itself, forming VGAM347 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM347 folded precursor RNA, herein designated VGAM FOLDED PRECURSOR RNA, into VGAM347 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM347 RNA is designated SEQ ID:682, and is provided hereinbelow with reference to the sequence listing part.

VGAM347 host target gene, herein designated VGAM HOST TARGET GENE, encodes a corresponding messenger RNA, VGAM347 host target RNA, herein designated VGAM HOST TARGET RNA. VGAM347 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM347 RNA, herein designated VGAM RNA, binds complementarily to one or more host target binding sites located in untranslated regions of VGAM347 host target RNA, herein designated VGAM HOST TARGET RNA. This complementary binding is due to the fact that the nucleotide sequence of VGAM347 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM347 RNA, herein designated VGAM RNA, may have a different number of host target binding sites in untranslated regions of a VGAM347 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM347 RNA, herein designated VGAM RNA, to host target binding sites on VGAM347 host target RNA, herein designated VGAM HOST TARGET RNA, such as BINDING SITE I, BINDING SITE II and BINDING SITE III, inhibits translation of VGAM347 host target RNA, herein designated VGAM HOST TARGET RNA, into VGAM347 host target protein, herein designated VGAM HOST TARGET PROTEIN. VGAM host target protein is therefore outlined by a broken line.

It is appreciated that VGAM347 host target gene, herein designated VGAM HOST TARGET GENE, in fact represents a plurality of VGAM347 host target genes. The mRNA of each one of this plurality of VGAM347 host target genes comprises one or more host target binding sites, each having a nucleotide sequence which is at least partly complementary to VGAM347 RNA, herein designated VGAM RNA, and which when bound by VGAM347 RNA, herein designated VGAM RNA, causes inhibition of translation of respective one or more VGAM347 host target proteins.

It is further appreciated by one skilled in the art that the mode of translational inhibition illustrated by FIG. 1 with specific reference to translational inhibition exerted by VGAM347 gene, herein designated VGAM GENE, on one or more VGAM347 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM347 is inhibition of expression of host target genes, as part of a novel viral mechanism of attacking a host. Accordingly, utilities of VGAM347 include diagnosis, prevention and treatment of viral infection by Vaccinia virus. Specific functions, and accordingly utilities, of VGAM347 correlate with, and may be deduced from, the identity of the host target genes which VGAM347 binds and inhibits, and the function of these host target genes, as elaborated hereinbelow.

Nucleotide sequences of the VGAM347 precursor RNA, herein designated VGAM PRECURSOR RNA, and of the diced VGAM347 RNA, herein designated VGAM RNA, and a schematic representation of the secondary folding of VGAM347 folded precursor RNA, herein designated VGAM FOLDED PRECURSOR RNA, of VGAM347 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM347 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 348 (VGAM348) viral gene, which modulates expression of respective host target genes thereof, the function and utility of which host target genes is known in the art.

VGAM348 is a novel bioinformatically detected regulatory, non protein coding, viral micro RNA (miRNA) gene. The method by which VGAM348 was detected is described hereinabove with reference to FIGS. 2-8.

VGAM348 gene, herein designated VGAM GENE, is a viral gene contained in the genome of Vaccinia virus. VGAM348 host target gene, herein designated VGAM HOST TARGET GENE, is a human gene contained in the human genome.

VGAM348 gene, herein designated VGAM GENE, encodes a VGAM348 precursor RNA, herein designated VGAM PRECURSOR RNA. Similar to other miRNA genes, and unlike most ordinary genes, VGAM348 precursor RNA, herein designated VGAM PRECURSOR RNA, does not encode a protein. A nucleotide sequence identical or highly similar to the nucleotide sequence of VGAM348 precursor RNA is designated SEQ ID:334, and is provided hereinbelow with reference to the sequence listing part. Nucleotide sequence SEQ ID:334 is located at position 963 relative to the genome of Vaccinia virus.

VGAM348 precursor RNA, herein designated VGAM PRECURSOR RNA, folds onto itself, forming VGAM348 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM348 folded precursor RNA, herein designated VGAM FOLDED PRECURSOR RNA, into VGAM348 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM348 RNA is designated SEQ ID:683, and is provided hereinbelow with reference to the sequence listing part.

VGAM348 host target gene, herein designated VGAM HOST TARGET GENE, encodes a corresponding messenger RNA, VGAM348 host target RNA, herein designated VGAM HOST TARGET RNA. VGAM348 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM348 RNA, herein designated VGAM RNA, binds complementarily to one or more host target binding sites located in untranslated regions of VGAM348 host target RNA, herein designated VGAM HOST TARGET RNA. This complementary binding is due to the fact that the nucleotide sequence of VGAM348 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM348 RNA, herein designated VGAM RNA, may have a different number of host target binding sites in untranslated regions of a VGAM348 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM348 RNA, herein designated VGAM RNA, to host target binding sites on VGAM348 host target RNA, herein designated VGAM HOST TARGET RNA, such as BINDING SITE I, BINDING SITE II and BINDING SITE III, inhibits translation of VGAM348 host target RNA, herein designated VGAM HOST TARGET RNA, into VGAM348 host target protein, herein designated VGAM HOST TARGET PROTEIN. VGAM host target protein is therefore outlined by a broken line.

It is appreciated that VGAM348 host target gene, herein designated VGAM HOST TARGET GENE, in fact represents a plurality of VGAM348 host target genes. The mRNA of each one of this plurality of VGAM348 host target genes comprises one or more host target binding sites, each having a nucleotide sequence which is at least partly complementary to VGAM348 RNA, herein designated VGAM RNA, and which when bound by VGAM348 RNA, herein designated VGAM RNA, causes inhibition of translation of respective one or more VGAM348 host target proteins.

It is further appreciated by one skilled in the art that the mode of translational inhibition illustrated by FIG. 1 with specific reference to translational inhibition exerted by VGAM348 gene, herein designated VGAM GENE, on one or more VGAM348 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM348 is inhibition of expression of host target genes, as part of a novel viral mechanism of attacking a host. Accordingly, utilities of VGAM348 include diagnosis, prevention and treatment of viral infection by Vaccinia virus. Specific functions, and accordingly utilities, of VGAM348 correlate with, and may be deduced from, the identity of the host target genes which VGAM348 binds and inhibits, and the function of these host target genes, as elaborated hereinbelow.

Nucleotide sequences of the VGAM348 precursor RNA, herein designated VGAM PRECURSOR RNA, and of the diced VGAM348 RNA, herein designated VGAM RNA, and a schematic representation of the secondary folding of VGAM348 folded precursor RNA, herein designated VGAM FOLDED PRECURSOR RNA, of VGAM348 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM348 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 349 (VGAM349) viral gene, which modulates expression of respective host target genes thereof, the function and utility of which host target genes is known in the art.

VGAM349 is a novel bioinformatically detected regulatory, non protein coding, viral micro RNA (miRNA) gene. The method by which VGAM349 was detected is described hereinabove with reference to FIGS. 2-8.

VGAM349 gene, herein designated VGAM GENE, is a viral gene contained in the genome of Vaccinia virus. VGAM349 host target gene, herein designated VGAM HOST TARGET GENE, is a human gene contained in the human genome.

VGAM349 gene, herein designated VGAM GENE, encodes a VGAM349 precursor RNA, herein designated VGAM PRECURSOR RNA. Similar to other miRNA genes, and unlike most ordinary genes, VGAM349 precursor RNA, herein designated VGAM PRECURSOR RNA, does not encode a protein. A nucleotide sequence identical or highly similar to the nucleotide sequence of VGAM349 precursor RNA is designated SEQ ID:335, and is provided hereinbelow with reference to the sequence listing part. Nucleotide sequence SEQ ID:335 is located at position 963 relative to the genome of Vaccinia virus.

VGAM349 precursor RNA, herein designated VGAM PRECURSOR RNA, folds onto itself, forming VGAM349 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM349 folded precursor RNA, herein designated VGAM FOLDED PRECURSOR RNA, into VGAM349 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM349 RNA is designated SEQ ID:684, and is provided hereinbelow with reference to the sequence listing part.

VGAM349 host target gene, herein designated VGAM HOST TARGET GENE, encodes a corresponding messenger RNA, VGAM349 host target RNA, herein designated VGAM HOST TARGET RNA. VGAM349 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM349 RNA, herein designated VGAM RNA, binds complementarily to one or more host target binding sites located in untranslated regions of VGAM349 host target RNA, herein designated VGAM HOST TARGET RNA. This complementary binding is due to the fact that the nucleotide sequence of VGAM349 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM349 RNA, herein designated VGAM RNA, may have a different number of host target binding sites in untranslated regions of a VGAM349 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM349 RNA, herein designated VGAM RNA, to host target binding sites on VGAM349 host target RNA, herein designated VGAM HOST TARGET RNA, such as BINDING SITE I, BINDING SITE II and BINDING SITE III, inhibits translation of VGAM349 host target RNA, herein designated VGAM HOST TARGET RNA, into VGAM349 host target protein, herein designated VGAM HOST TARGET PROTEIN. VGAM host target protein is therefore outlined by a broken line.

It is appreciated that VGAM349 host target gene, herein designated VGAM HOST TARGET GENE, in fact represents a plurality of VGAM349 host target genes. The mRNA of each one of this plurality of VGAM349 host target genes comprises one or more host target binding sites, each having a nucleotide sequence which is at least partly complementary to VGAM349 RNA, herein designated VGAM RNA, and which when bound by VGAM349 RNA, herein designated VGAM RNA, causes inhibition of translation of respective one or more VGAM349 host target proteins.

It is further appreciated by one skilled in the art that the mode of translational inhibition illustrated by FIG. 1 with specific reference to translational inhibition exerted by VGAM349 gene, herein designated VGAM GENE, on one or more VGAM349 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM349 is inhibition of expression of host target genes, as part of a novel viral mechanism of attacking a host. Accordingly, utilities of VGAM349 include diagnosis, prevention and treatment of viral infection by Vaccinia virus. Specific functions, and accordingly utilities, of VGAM349 correlate with, and may be deduced from, the identity of the host target genes which VGAM349 binds and inhibits, and the function of these host target genes, as elaborated hereinbelow.

Nucleotide sequences of the VGAM349 precursor RNA, herein designated VGAM PRECURSOR RNA, and of the diced VGAM349 RNA, herein designated VGAM RNA, and a schematic representation of the secondary folding of VGAM349 folded precursor RNA, herein designated VGAM FOLDED PRECURSOR RNA, of VGAM349 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM349 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 350 (VGAM350) viral gene, which modulates expression of respective host target genes thereof, the function and utility of which host target genes is known in the art.

VGAM350 is a novel bioinformatically detected regulatory, non protein coding, viral micro RNA (miRNA) gene. The method by which VGAM350 was detected is described hereinabove with reference to FIGS. 2-8.

VGAM350 gene, herein designated VGAM GENE, is a viral gene contained in the genome of Vaccinia virus. VGAM350 host target gene, herein designated VGAM HOST TARGET GENE, is a human gene contained in the human genome.

VGAM350 gene, herein designated VGAM GENE, encodes a VGAM350 precursor RNA, herein designated VGAM PRECURSOR RNA. Similar to other miRNA genes, and unlike most ordinary genes, VGAM350 precursor RNA, herein designated VGAM PRECURSOR RNA, does not encode a protein. A nucleotide sequence identical or highly similar to the nucleotide sequence of VGAM350 precursor RNA is designated SEQ ID:336, and is provided hereinbelow with reference to the sequence listing part. Nucleotide sequence SEQ ID:336 is located at position 963 relative to the genome of Vaccinia virus.

VGAM350 precursor RNA, herein designated VGAM PRECURSOR RNA, folds onto itself, forming VGAM350 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM350 folded precursor RNA, herein designated VGAM FOLDED PRECURSOR RNA, into VGAM350 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM350 RNA is designated SEQ ID:685, and is provided hereinbelow with reference to the sequence listing part.

VGAM350 host target gene, herein designated VGAM HOST TARGET GENE, encodes a corresponding messenger RNA, VGAM350 host target RNA, herein designated VGAM HOST TARGET RNA. VGAM350 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM350 RNA, herein designated VGAM RNA, binds complementarily to one or more host target binding sites located in untranslated regions of VGAM350 host target RNA, herein designated VGAM HOST TARGET RNA. This complementary binding is due to the fact that the nucleotide sequence of VGAM350 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM350 RNA, herein designated VGAM RNA, may have a different number of host target binding sites in untranslated regions of a VGAM350 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM350 RNA, herein designated VGAM RNA, to host target binding sites on VGAM350 host target RNA, herein designated VGAM HOST TARGET RNA, such as BINDING SITE I, BINDING SITE II and BINDING SITE III, inhibits translation of VGAM350 host target RNA, herein designated VGAM HOST TARGET RNA, into VGAM350 host target protein, herein designated VGAM HOST TARGET PROTEIN. VGAM host target protein is therefore outlined by a broken line.

It is appreciated that VGAM350 host target gene, herein designated VGAM HOST TARGET GENE, in fact represents a plurality of VGAM350 host target genes. The mRNA of each one of this plurality of VGAM350 host target genes comprises one or more host target binding sites, each having a nucleotide sequence which is at least partly complementary to VGAM350 RNA, herein designated VGAM RNA, and which when bound by VGAM350 RNA, herein designated VGAM RNA, causes inhibition of translation of respective one or more VGAM350 host target proteins.

It is further appreciated by one skilled in the art that the mode of translational inhibition illustrated by FIG. 1 with specific reference to translational inhibition exerted by VGAM350 gene, herein designated VGAM GENE, on one or more VGAM350 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM350 is inhibition of expression of host target genes, as part of a novel viral mechanism of attacking a host. Accordingly, utilities of VGAM350 include diagnosis, prevention and treatment of viral infection by Vaccinia virus. Specific functions, and accordingly utilities, of VGAM350 correlate with, and may be deduced from, the identity of the host target genes which VGAM350 binds and inhibits, and the function of these host target genes, as elaborated hereinbelow.

Nucleotide sequences of the VGAM350 precursor RNA, herein designated VGAM PRECURSOR RNA, and of the diced VGAM350 RNA, herein designated VGAM RNA, and a schematic representation of the secondary folding of VGAM350 folded precursor RNA, herein designated VGAM FOLDED PRECURSOR RNA, of VGAM350 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM350 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 351 (VGAM351) viral gene, which modulates expression of respective host target genes thereof, the function and utility of which host target genes is known in the art.

VGAM351 is a novel bioinformatically detected regulatory, non protein coding, viral micro RNA (miRNA) gene. The method by which VGAM351 was detected is described hereinabove with reference to FIGS. 2-8.

VGAM351 gene, herein designated VGAM GENE, is a viral gene contained in the genome of Vaccinia virus. VGAM351 host target gene, herein designated VGAM HOST TARGET GENE, is a human gene contained in the human genome.

VGAM351 gene, herein designated VGAM GENE, encodes a VGAM351 precursor RNA, herein designated VGAM PRECURSOR RNA. Similar to other miRNA genes, and unlike most ordinary genes, VGAM351 precursor RNA, herein designated VGAM PRECURSOR RNA, does not encode a protein. A nucleotide sequence identical or highly similar to the nucleotide sequence of VGAM351 precursor RNA is designated SEQ ID:337, and is provided hereinbelow with reference to the sequence listing part. Nucleotide sequence SEQ ID:337 is located at position 963 relative to the genome of Vaccinia virus.

VGAM351 precursor RNA, herein designated VGAM PRECURSOR RNA, folds onto itself, forming VGAM351 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM351 folded precursor RNA, herein designated VGAM FOLDED PRECURSOR RNA, into VGAM351 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM351 RNA is designated SEQ ID:686, and is provided hereinbelow with reference to the sequence listing part.

VGAM351 host target gene, herein designated VGAM HOST TARGET GENE, encodes a corresponding messenger RNA, VGAM351 host target RNA, herein designated VGAM HOST TARGET RNA. VGAM351 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM351 RNA, herein designated VGAM RNA, binds complementarily to one or more host target binding sites located in untranslated regions of VGAM351 host target RNA, herein designated VGAM HOST TARGET RNA. This complementary binding is due to the fact that the nucleotide sequence of VGAM351 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM351 RNA, herein designated VGAM RNA, may have a different number of host target binding sites in untranslated regions of a VGAM351 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM351 RNA, herein designated VGAM RNA, to host target binding sites on VGAM351 host target RNA, herein designated VGAM HOST TARGET RNA, such as BINDING SITE I, BINDING SITE II and BINDING SITE III, inhibits translation of VGAM351 host target RNA, herein designated VGAM HOST TARGET RNA, into VGAM351 host target protein, herein designated VGAM HOST TARGET PROTEIN. VGAM host target protein is therefore outlined by a broken line.

It is appreciated that VGAM351 host target gene, herein designated VGAM HOST TARGET GENE, in fact represents a plurality of VGAM351 host target genes. The mRNA of each one of this plurality of VGAM351 host target genes comprises one or more host target binding sites, each having a nucleotide sequence which is at least partly complementary to VGAM351 RNA, herein designated VGAM RNA, and which when bound by VGAM351 RNA, herein designated VGAM RNA, causes inhibition of translation of respective one or more VGAM351 host target proteins.

It is further appreciated by one skilled in the art that the mode of translational inhibition illustrated by FIG. 1 with specific reference to translational inhibition exerted by VGAM351 gene, herein designated VGAM GENE, on one or more VGAM351 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM351 is inhibition of expression of host target genes, as part of a novel viral mechanism of attacking a host. Accordingly, utilities of VGAM351 include diagnosis, prevention and treatment of viral infection by Vaccinia virus. Specific functions, and accordingly utilities, of VGAM351 correlate with, and may be deduced from, the identity of the host target genes which VGAM351 binds and inhibits, and the function of these host target genes, as elaborated hereinbelow.

Nucleotide sequences of the VGAM351 precursor RNA, herein designated VGAM PRECURSOR RNA, and of the diced VGAM351 RNA, herein designated VGAM RNA, and a schematic representation of the secondary folding of VGAM351 folded precursor RNA, herein designated VGAM FOLDED PRECURSOR RNA, of VGAM351 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM351 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 352 (VGAM352) viral gene, which modulates expression of respective host target genes thereof, the function and utility of which host target genes is known in the art.

VGAM352 is a novel bioinformatically detected regulatory, non protein coding, viral micro RNA (miRNA) gene. The method by which VGAM352 was detected is described hereinabove with reference to FIGS. 2-8.

VGAM352 gene, herein designated VGAM GENE, is a viral gene contained in the genome of Vaccinia virus. VGAM352 host target gene, herein designated VGAM HOST TARGET GENE, is a human gene contained in the human genome.

VGAM352 gene, herein designated VGAM GENE, encodes a VGAM352 precursor RNA, herein designated VGAM PRECURSOR RNA. Similar to other miRNA genes, and unlike most ordinary genes, VGAM352 precursor RNA, herein designated VGAM PRECURSOR RNA, does not encode a protein. A nucleotide sequence identical or highly similar to the nucleotide sequence of VGAM352 precursor RNA is designated SEQ ID:338, and is provided hereinbelow with reference to the sequence listing part. Nucleotide sequence SEQ ID:338 is located at position 2576 relative to the genome of Vaccinia virus.

VGAM352 precursor RNA, herein designated VGAM PRECURSOR RNA, folds onto itself, forming VGAM352 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM352 folded precursor RNA, herein designated VGAM FOLDED PRECURSOR RNA, into VGAM352 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM352 RNA is designated SEQ ID:687, and is provided hereinbelow with reference to the sequence listing part.

VGAM352 host target gene, herein designated VGAM HOST TARGET GENE, encodes a corresponding messenger RNA, VGAM352 host target RNA, herein designated VGAM HOST TARGET RNA. VGAM352 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM352 RNA, herein designated VGAM RNA, binds complementarily to one or more host target binding sites located in untranslated regions of VGAM352 host target RNA, herein designated VGAM HOST TARGET RNA. This complementary binding is due to the fact that the nucleotide sequence of VGAM352 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM352 RNA, herein designated VGAM RNA, may have a different number of host target binding sites in untranslated regions of a VGAM352 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM352 RNA, herein designated VGAM RNA, to host target binding sites on VGAM352 host target RNA, herein designated VGAM HOST TARGET RNA, such as BINDING SITE I, BINDING SITE II and BINDING SITE III, inhibits translation of VGAM352 host target RNA, herein designated VGAM HOST TARGET RNA, into VGAM352 host target protein, herein designated VGAM HOST TARGET PROTEIN. VGAM host target protein is therefore outlined by a broken line.

It is appreciated that VGAM352 host target gene, herein designated VGAM HOST TARGET GENE, in fact represents a plurality of VGAM352 host target genes. The mRNA of each one of this plurality of VGAM352 host target genes comprises one or more host target binding sites, each having a nucleotide sequence which is at least partly complementary to VGAM352 RNA, herein designated VGAM RNA, and which when bound by VGAM352 RNA, herein designated VGAM RNA, causes inhibition of translation of respective one or more VGAM352 host target proteins.

It is further appreciated by one skilled in the art that the mode of translational inhibition illustrated by FIG. 1 with specific reference to translational inhibition exerted by VGAM352 gene, herein designated VGAM GENE, on one or more VGAM352 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM352 is inhibition of expression of host target genes, as part of a novel viral mechanism of attacking a host. Accordingly, utilities of VGAM352 include diagnosis, prevention and treatment of viral infection by Vaccinia virus. Specific functions, and accordingly utilities, of VGAM352 correlate with, and may be deduced from, the identity of the host target genes which VGAM352 binds and inhibits, and the function of these host target genes, as elaborated hereinbelow.

Nucleotide sequences of the VGAM352 precursor RNA, herein designated VGAM PRECURSOR RNA, and of the diced VGAM352 RNA, herein designated VGAM RNA, and a schematic representation of the secondary folding of VGAM352 folded precursor RNA, herein designated VGAM FOLDED PRECURSOR RNA, of VGAM352 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM352 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 353 (VGAM353) viral gene, which modulates expression of respective host target genes thereof, the function and utility of which host target genes is known in the art.

VGAM353 is a novel bioinformatically detected regulatory, non protein coding, viral micro RNA (miRNA) gene. The method by which VGAM353 was detected is described hereinabove with reference to FIGS. 2-8.

VGAM353 gene, herein designated VGAM GENE, is a viral gene contained in the genome of Vaccinia virus. VGAM353 host target gene, herein designated VGAM HOST TARGET GENE, is a human gene contained in the human genome.

VGAM353 gene, herein designated VGAM GENE, encodes a VGAM353 precursor RNA, herein designated VGAM PRECURSOR RNA. Similar to other miRNA genes, and unlike most ordinary genes, VGAM353 precursor RNA, herein designated VGAM PRECURSOR RNA, does not encode a protein. A nucleotide sequence identical or highly similar to the nucleotide sequence of VGAM353 precursor RNA is designated SEQ ID:339, and is provided hereinbelow with reference to the sequence listing part. Nucleotide sequence SEQ ID:339 is located at position 4213 relative to the genome of Vaccinia virus.

VGAM353 precursor RNA, herein designated VGAM PRECURSOR RNA, folds onto itself, forming VGAM353 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM353 folded precursor RNA, herein designated VGAM FOLDED PRECURSOR RNA, into VGAM353 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM353 RNA is designated SEQ ID:688, and is provided hereinbelow with reference to the sequence listing part.

VGAM353 host target gene, herein designated VGAM HOST TARGET GENE, encodes a corresponding messenger RNA, VGAM353 host target RNA, herein designated VGAM HOST TARGET RNA. VGAM353 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM353 RNA, herein designated VGAM RNA, binds complementarily to one or more host target binding sites located in untranslated regions of VGAM353 host target RNA, herein designated VGAM HOST TARGET RNA. This complementary binding is due to the fact that the nucleotide sequence of VGAM353 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM353 RNA, herein designated VGAM RNA, may have a different number of host target binding sites in untranslated regions of a VGAM353 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM353 RNA, herein designated VGAM RNA, to host target binding sites on VGAM353 host target RNA, herein designated VGAM HOST TARGET RNA, such as BINDING SITE I, BINDING SITE II and BINDING SITE III, inhibits translation of VGAM353 host target RNA, herein designated VGAM HOST TARGET RNA, into VGAM353 host target protein, herein designated VGAM HOST TARGET PROTEIN. VGAM host target protein is therefore outlined by a broken line.

It is appreciated that VGAM353 host target gene, herein designated VGAM HOST TARGET GENE, in fact represents a plurality of VGAM353 host target genes. The mRNA of each one of this plurality of VGAM353 host target genes comprises one or more host target binding sites, each having a nucleotide sequence which is at least partly complementary to VGAM353 RNA, herein designated VGAM RNA, and which when bound by VGAM353 RNA, herein designated VGAM RNA, causes inhibition of translation of respective one or more VGAM353 host target proteins.

It is further appreciated by one skilled in the art that the mode of translational inhibition illustrated by FIG. 1 with specific reference to translational inhibition exerted by VGAM353 gene, herein designated VGAM GENE, on one or more VGAM353 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM353 is inhibition of expression of host target genes, as part of a novel viral mechanism of attacking a host. Accordingly, utilities of VGAM353 include diagnosis, prevention and treatment of viral infection by Vaccinia virus. Specific functions, and accordingly utilities, of VGAM353 correlate with, and may be deduced from, the identity of the host target genes which VGAM353 binds and inhibits, and the function of these host target genes, as elaborated hereinbelow.

Nucleotide sequences of the VGAM353 precursor RNA, herein designated VGAM PRECURSOR RNA, and of the diced VGAM353 RNA, herein designated VGAM RNA, and a schematic representation of the secondary folding of VGAM353 folded precursor RNA, herein designated VGAM FOLDED PRECURSOR RNA, of VGAM353 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM353 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 354 (VGAM354) viral gene, which modulates expression of respective host target genes thereof, the function and utility of which host target genes is known in the art.

VGAM354 is a novel bioinformatically detected regulatory, non protein coding, viral micro RNA (miRNA) gene. The method by which VGAM354 was detected is described hereinabove with reference to FIGS. 2-8.

VGAM354 gene, herein designated VGAM GENE, is a viral gene contained in the genome of Vaccinia virus. VGAM354 host target gene, herein designated VGAM HOST TARGET GENE, is a human gene contained in the human genome.

VGAM354 gene, herein designated VGAM GENE, encodes a VGAM354 precursor RNA, herein designated VGAM PRECURSOR RNA. Similar to other miRNA genes, and unlike most ordinary genes, VGAM354 precursor RNA, herein designated VGAM PRECURSOR RNA, does not encode a protein. A nucleotide sequence identical or highly similar to the nucleotide sequence of VGAM354 precursor RNA is designated SEQ ID:340, and is provided hereinbelow with reference to the sequence listing part. Nucleotide sequence SEQ ID:340 is located at position 3249 relative to the genome of Vaccinia virus.

VGAM354 precursor RNA, herein designated VGAM PRECURSOR RNA, folds onto itself, forming VGAM354 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM354 folded precursor RNA, herein designated VGAM FOLDED PRECURSOR RNA, into VGAM354 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 76%) nucleotide sequence of VGAM354 RNA is designated SEQ ID:689, and is provided hereinbelow with reference to the sequence listing part.

VGAM354 host target gene, herein designated VGAM HOST TARGET GENE, encodes a corresponding messenger RNA, VGAM354 host target RNA, herein designated VGAM HOST TARGET RNA. VGAM354 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM354 RNA, herein designated VGAM RNA, binds complementarily to one or more host target binding sites located in untranslated regions of VGAM354 host target RNA, herein designated VGAM HOST TARGET RNA. This complementary binding is due to the fact that the nucleotide sequence of VGAM354 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM354 RNA, herein designated VGAM RNA, may have a different number of host target binding sites in untranslated regions of a VGAM354 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM354 RNA, herein designated VGAM RNA, to host target binding sites on VGAM354 host target RNA, herein designated VGAM HOST TARGET RNA, such as BINDING SITE I, BINDING SITE II and BINDING SITE III, inhibits translation of VGAM354 host target RNA, herein designated VGAM HOST TARGET RNA, into VGAM354 host target protein, herein designated VGAM HOST TARGET PROTEIN. VGAM host target protein is therefore outlined by a broken line.

It is appreciated that VGAM354 host target gene, herein designated VGAM HOST TARGET GENE, in fact represents a plurality of VGAM354 host target genes. The mRNA of each one of this plurality of VGAM354 host target genes comprises one or more host target binding sites, each having a nucleotide sequence which is at least partly complementary to VGAM354 RNA, herein designated VGAM RNA, and which when bound by VGAM354 RNA, herein designated VGAM RNA, causes inhibition of translation of respective one or more VGAM354 host target proteins.

It is further appreciated by one skilled in the art that the mode of translational inhibition illustrated by FIG. 1 with specific reference to translational inhibition exerted by VGAM354 gene, herein designated VGAM GENE, on one or more VGAM354 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM354 is inhibition of expression of host target genes, as part of a novel viral mechanism of attacking a host. Accordingly, utilities of VGAM354 include diagnosis, prevention and treatment of viral infection by Vaccinia virus. Specific functions, and accordingly utilities, of VGAM354 correlate with, and may be deduced from, the identity of the host target genes which VGAM354 binds and inhibits, and the function of these host target genes, as elaborated hereinbelow.

Nucleotide sequences of the VGAM354 precursor RNA, herein designated VGAM PRECURSOR RNA, and of the diced VGAM354 RNA, herein designated VGAM RNA, and a schematic representation of the secondary folding of VGAM354 folded precursor RNA, herein designated VGAM FOLDED PRECURSOR RNA, of VGAM354 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM354 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 355 (VGAM355) viral gene, which modulates expression of respective host target genes thereof, the function and utility of which host target genes is known in the art.

VGAM355 is a novel bioinformatically detected regulatory, non protein coding, viral micro RNA (miRNA) gene. The method by which VGAM355 was detected is described hereinabove with reference to FIGS. 2-8.

VGAM355 gene, herein designated VGAM GENE, is a viral gene contained in the genome of Vaccinia virus. VGAM355 host target gene, herein designated VGAM HOST TARGET GENE, is a human gene contained in the human genome.

VGAM355 gene, herein designated VGAM GENE, encodes a VGAM355 precursor RNA, herein designated VGAM PRECURSOR RNA. Similar to other miRNA genes, and unlike most ordinary genes, VGAM355 precursor RNA, herein designated VGAM PRECURSOR RNA, does not encode a protein. A nucleotide sequence identical or highly similar to the nucleotide sequence of VGAM355 precursor RNA is designated SEQ ID:341, and is provided hereinbelow with reference to the sequence listing part. Nucleotide sequence SEQ ID:341 is located at position 3686 relative to the genome of Vaccinia virus.

VGAM355 precursor RNA, herein designated VGAM PRECURSOR RNA, folds onto itself, forming VGAM355 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM355 folded precursor RNA, herein designated VGAM FOLDED PRECURSOR RNA, into VGAM355 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 74%) nucleotide sequence of VGAM355 RNA is designated SEQ ID:690, and is provided hereinbelow with reference to the sequence listing part.

VGAM355 host target gene, herein designated VGAM HOST TARGET GENE, encodes a corresponding messenger RNA, VGAM355 host target RNA, herein designated VGAM HOST TARGET RNA. VGAM355 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM355 RNA, herein designated VGAM RNA, binds complementarily to one or more host target binding sites located in untranslated regions of VGAM355 host target RNA, herein designated VGAM HOST TARGET RNA. This complementary binding is due to the fact that the nucleotide sequence of VGAM355 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM355 RNA, herein designated VGAM RNA, may have a different number of host target binding sites in untranslated regions of a VGAM355 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM355 RNA, herein designated VGAM RNA, to host target binding sites on VGAM355 host target RNA, herein designated VGAM HOST TARGET RNA, such as BINDING SITE I, BINDING SITE II and BINDING SITE III, inhibits translation of VGAM355 host target RNA, herein designated VGAM HOST TARGET RNA, into VGAM355 host target protein, herein designated VGAM HOST TARGET PROTEIN. VGAM host target protein is therefore outlined by a broken line.

It is appreciated that VGAM355 host target gene, herein designated VGAM HOST TARGET GENE, in fact represents a plurality of VGAM355 host target genes. The mRNA of each one of this plurality of VGAM355 host target genes comprises one or more host target binding sites, each having a nucleotide sequence which is at least partly complementary to VGAM355 RNA, herein designated VGAM RNA, and which when bound by VGAM355 RNA, herein designated VGAM RNA, causes inhibition of translation of respective one or more VGAM355 host target proteins.

It is further appreciated by one skilled in the art that the mode of translational inhibition illustrated by FIG. 1 with specific reference to translational inhibition exerted by VGAM355 gene, herein designated VGAM GENE, on one or more VGAM355 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM355 is inhibition of expression of host target genes, as part of a novel viral mechanism of attacking a host. Accordingly, utilities of VGAM355 include diagnosis, prevention and treatment of viral infection by Vaccinia virus. Specific functions, and accordingly utilities, of VGAM355 correlate with, and may be deduced from, the identity of the host target genes which VGAM355 binds and inhibits, and the function of these host target genes, as elaborated hereinbelow.

Nucleotide sequences of the VGAM355 precursor RNA, herein designated VGAM PRECURSOR RNA, and of the diced VGAM355 RNA, herein designated VGAM RNA, and a schematic representation of the secondary folding of VGAM355 folded precursor RNA, herein designated VGAM FOLDED PRECURSOR RNA, of VGAM355 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM355 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 356 (VGAM356) viral gene, which modulates expression of respective host target genes thereof, the function and utility of which host target genes is known in the art.

VGAM356 is a novel bioinformatically detected regulatory, non protein coding, viral micro RNA (miRNA) gene. The method by which VGAM356 was detected is described hereinabove with reference to FIGS. 2-8.

VGAM356 gene, herein designated VGAM GENE, is a viral gene contained in the genome of Vaccinia virus. VGAM356 host target gene, herein designated VGAM HOST TARGET GENE, is a human gene contained in the human genome.

VGAM356 gene, herein designated VGAM GENE, encodes a VGAM356 precursor RNA, herein designated VGAM PRECURSOR RNA. Similar to other miRNA genes, and unlike most ordinary genes, VGAM356 precursor RNA, herein designated VGAM PRECURSOR RNA, does not encode a protein. A nucleotide sequence identical or highly similar to the nucleotide sequence of VGAM356 precursor RNA is designated SEQ ID:342, and is provided hereinbelow with reference to the sequence listing part. Nucleotide sequence SEQ ID:342 is located at position 3573 relative to the genome of Vaccinia virus.

VGAM356 precursor RNA, herein designated VGAM PRECURSOR RNA, folds onto itself, forming VGAM356 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM356 folded precursor RNA, herein designated VGAM FOLDED PRECURSOR RNA, into VGAM356 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 81%) nucleotide sequence of VGAM356 RNA is designated SEQ ID:691, and is provided hereinbelow with reference to the sequence listing part.

VGAM356 host target gene, herein designated VGAM HOST TARGET GENE, encodes a corresponding messenger RNA, VGAM356 host target RNA, herein designated VGAM HOST TARGET RNA. VGAM356 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM356 RNA, herein designated VGAM RNA, binds complementarily to one or more host target binding sites located in untranslated regions of VGAM356 host target RNA, herein designated VGAM HOST TARGET RNA. This complementary binding is due to the fact that the nucleotide sequence of VGAM356 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM356 RNA, herein designated VGAM RNA, may have a different number of host target binding sites in untranslated regions of a VGAM356 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM356 RNA, herein designated VGAM RNA, to host target binding sites on VGAM356 host target RNA, herein designated VGAM HOST TARGET RNA, such as BINDING SITE I, BINDING SITE II and BINDING SITE III, inhibits translation of VGAM356 host target RNA, herein designated VGAM HOST TARGET RNA, into VGAM356 host target protein, herein designated VGAM HOST TARGET PROTEIN. VGAM host target protein is therefore outlined by a broken line.

It is appreciated that VGAM356 host target gene, herein designated VGAM HOST TARGET GENE, in fact represents a plurality of VGAM356 host target genes. The mRNA of each one of this plurality of VGAM356 host target genes comprises one or more host target binding sites, each having a nucleotide sequence which is at least partly complementary to VGAM356 RNA, herein designated VGAM RNA, and which when bound by VGAM356 RNA, herein designated VGAM RNA, causes inhibition of translation of respective one or more VGAM356 host target proteins.

It is further appreciated by one skilled in the art that the mode of translational inhibition illustrated by FIG. 1 with specific reference to translational inhibition exerted by VGAM356 gene, herein designated VGAM GENE, on one or more VGAM356 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM356 is inhibition of expression of host target genes, as part of a novel viral mechanism of attacking a host. Accordingly, utilities of VGAM356 include diagnosis, prevention and treatment of viral infection by Vaccinia virus. Specific functions, and accordingly utilities, of VGAM356 correlate with, and may be deduced from, the identity of the host target genes which VGAM356 binds and inhibits, and the function of these host target genes, as elaborated hereinbelow.

Nucleotide sequences of the VGAM356 precursor RNA, herein designated VGAM PRECURSOR RNA, and of the diced VGAM356 RNA, herein designated VGAM RNA, and a schematic representation of the secondary folding of VGAM356 folded precursor RNA, herein designated VGAM FOLDED PRECURSOR RNA, of VGAM356 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM356 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 357 (VGAM357) viral gene, which modulates expression of respective host target genes thereof, the function and utility of which host target genes is known in the art.

VGAM357 is a novel bioinformatically detected regulatory, non protein coding, viral micro RNA (miRNA) gene. The method by which VGAM357 was detected is described hereinabove with reference to FIGS. 2-8.

VGAM357 gene, herein designated VGAM GENE, is a viral gene contained in the genome of Vaccinia virus. VGAM357 host target gene, herein designated VGAM HOST TARGET GENE, is a human gene contained in the human genome.

VGAM357 gene, herein designated VGAM GENE, encodes a VGAM357 precursor RNA, herein designated VGAM PRECURSOR RNA. Similar to other miRNA genes, and unlike most ordinary genes, VGAM357 precursor RNA, herein designated VGAM PRECURSOR RNA, does not encode a protein. A nucleotide sequence identical or highly similar to the nucleotide sequence of VGAM357 precursor RNA is designated SEQ ID:343, and is provided hereinbelow with reference to the sequence listing part. Nucleotide sequence SEQ ID:343 is located at position 2870 relative to the genome of Vaccinia virus.

VGAM357 precursor RNA, herein designated VGAM PRECURSOR RNA, folds onto itself, forming VGAM357 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM357 folded precursor RNA, herein designated VGAM FOLDED PRECURSOR RNA, into VGAM357 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 81%) nucleotide sequence of VGAM357 RNA is designated SEQ ID:692, and is provided hereinbelow with reference to the sequence listing part.

VGAM357 host target gene, herein designated VGAM HOST TARGET GENE, encodes a corresponding messenger RNA, VGAM357 host target RNA, herein designated VGAM HOST TARGET RNA. VGAM357 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM357 RNA, herein designated VGAM RNA, binds complementarily to one or more host target binding sites located in untranslated regions of VGAM357 host target RNA, herein designated VGAM HOST TARGET RNA. This complementary binding is due to the fact that the nucleotide sequence of VGAM357 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM357 RNA, herein designated VGAM RNA, may have a different number of host target binding sites in untranslated regions of a VGAM357 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM357 RNA, herein designated VGAM RNA, to host target binding sites on VGAM357 host target RNA, herein designated VGAM HOST TARGET RNA, such as BINDING SITE I, BINDING SITE II and BINDING SITE III, inhibits translation of VGAM357 host target RNA, herein designated VGAM HOST TARGET RNA, into VGAM357 host target protein, herein designated VGAM HOST TARGET PROTEIN. VGAM host target protein is therefore outlined by a broken line.

It is appreciated that VGAM357 host target gene, herein designated VGAM HOST TARGET GENE, in fact represents a plurality of VGAM357 host target genes. The mRNA of each one of this plurality of VGAM357 host target genes comprises one or more host target binding sites, each having a nucleotide sequence which is at least partly complementary to VGAM357 RNA, herein designated VGAM RNA, and which when bound by VGAM357 RNA, herein designated VGAM RNA, causes inhibition of translation of respective one or more VGAM357 host target proteins.

It is further appreciated by one skilled in the art that the mode of translational inhibition illustrated by FIG. 1 with specific reference to translational inhibition exerted by VGAM357 gene, herein designated VGAM GENE, on one or more VGAM357 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM357 is inhibition of expression of host target genes, as part of a novel viral mechanism of attacking a host. Accordingly, utilities of VGAM357 include diagnosis, prevention and treatment of viral infection by Vaccinia virus. Specific functions, and accordingly utilities, of VGAM357 correlate with, and may be deduced from, the identity of the host target genes which VGAM357 binds and inhibits, and the function of these host target genes, as elaborated hereinbelow.

Nucleotide sequences of the VGAM357 precursor RNA, herein designated VGAM PRECURSOR RNA, and of the diced VGAM357 RNA, herein designated VGAM RNA, and a schematic representation of the secondary folding of VGAM357 folded precursor RNA, herein designated VGAM FOLDED PRECURSOR RNA, of VGAM357 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM357 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 358 (VGAM358) viral gene, which modulates expression of respective host target genes thereof, the function and utility of which host target genes is known in the art.

VGAM358 is a novel bioinformatically detected regulatory, non protein coding, viral micro RNA (miRNA) gene. The method by which VGAM358 was detected is described hereinabove with reference to FIGS. 2-8.

VGAM358 gene, herein designated VGAM GENE, is a viral gene contained in the genome of Vaccinia virus. VGAM358 host target gene, herein designated VGAM HOST TARGET GENE, is a human gene contained in the human genome.

VGAM358 gene, herein designated VGAM GENE, encodes a VGAM358 precursor RNA, herein designated VGAM PRECURSOR RNA. Similar to other miRNA genes, and unlike most ordinary genes, VGAM358 precursor RNA, herein designated VGAM PRECURSOR RNA, does not encode a protein. A nucleotide sequence identical or highly similar to the nucleotide sequence of VGAM358 precursor RNA is designated SEQ ID:344, and is provided hereinbelow with reference to the sequence listing part. Nucleotide sequence SEQ ID:344 is located at position 151547 relative to the genome of Vaccinia virus.

VGAM358 precursor RNA, herein designated VGAM PRECURSOR RNA, folds onto itself, forming VGAM358 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM358 folded precursor RNA, herein designated VGAM FOLDED PRECURSOR RNA, into VGAM358 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 92%) nucleotide sequence of VGAM358 RNA is designated SEQ ID:693, and is provided hereinbelow with reference to the sequence listing part.

VGAM358 host target gene, herein designated VGAM HOST TARGET GENE, encodes a corresponding messenger RNA, VGAM358 host target RNA, herein designated VGAM HOST TARGET RNA. VGAM358 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM358 RNA, herein designated VGAM RNA, binds complementarily to one or more host target binding sites located in untranslated regions of VGAM358 host target RNA, herein designated VGAM HOST TARGET RNA. This complementary binding is due to the fact that the nucleotide sequence of VGAM358 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM358 RNA, herein designated VGAM RNA, may have a different number of host target binding sites in untranslated regions of a VGAM358 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM358 RNA, herein designated VGAM RNA, to host target binding sites on VGAM358 host target RNA, herein designated VGAM HOST TARGET RNA, such as BINDING SITE I, BINDING SITE II and BINDING SITE III, inhibits translation of VGAM358 host target RNA, herein designated VGAM HOST TARGET RNA, into VGAM358 host target protein, herein designated VGAM HOST TARGET PROTEIN. VGAM host target protein is therefore outlined by a broken line.

It is appreciated that VGAM358 host target gene, herein designated VGAM HOST TARGET GENE, in fact represents a plurality of VGAM358 host target genes. The mRNA of each one of this plurality of VGAM358 host target genes comprises one or more host target binding sites, each having a nucleotide sequence which is at least partly complementary to VGAM358 RNA, herein designated VGAM RNA, and which when bound by VGAM358 RNA, herein designated VGAM RNA, causes inhibition of translation of respective one or more VGAM358 host target proteins.

It is further appreciated by one skilled in the art that the mode of translational inhibition illustrated by FIG. 1 with specific reference to translational inhibition exerted by VGAM358 gene, herein designated VGAM GENE, on one or more VGAM358 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM358 is inhibition of expression of host target genes, as part of a novel viral mechanism of attacking a host. Accordingly, utilities of VGAM358 include diagnosis, prevention and treatment of viral infection by Vaccinia virus. Specific functions, and accordingly utilities, of VGAM358 correlate with, and may be deduced from, the identity of the host target genes which VGAM358 binds and inhibits, and the function of these host target genes, as elaborated hereinbelow.

Nucleotide sequences of the VGAM358 precursor RNA, herein designated VGAM PRECURSOR RNA, and of the diced VGAM358 RNA, herein designated VGAM RNA, and a schematic representation of the secondary folding of VGAM358 folded precursor RNA, herein designated VGAM FOLDED PRECURSOR RNA, of VGAM358 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM358 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 359 (VGAM359) viral gene, which modulates expression of respective host target genes thereof, the function and utility of which host target genes is known in the art.

VGAM359 is a novel bioinformatically detected regulatory, non protein coding, viral micro RNA (miRNA) gene. The method by which VGAM359 was detected is described hereinabove with reference to FIGS. 2-8.

VGAM359 gene, herein designated VGAM GENE, is a viral gene contained in the genome of Vaccinia virus. VGAM359 host target gene, herein designated VGAM HOST TARGET GENE, is a human gene contained in the human genome.

VGAM359 gene, herein designated VGAM GENE, encodes a VGAM359 precursor RNA, herein designated VGAM PRECURSOR RNA. Similar to other miRNA genes, and unlike most ordinary genes, VGAM359 precursor RNA, herein designated VGAM PRECURSOR RNA, does not encode a protein. A nucleotide sequence identical or highly similar to the nucleotide sequence of VGAM359 precursor RNA is designated SEQ ID:345, and is provided hereinbelow with reference to the sequence listing part. Nucleotide sequence SEQ ID:345 is located at position 151270 relative to the genome of Vaccinia virus.

VGAM359 precursor RNA, herein designated VGAM PRECURSOR RNA, folds onto itself, forming VGAM359 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM359 folded precursor RNA, herein designated VGAM FOLDED PRECURSOR RNA, into VGAM359 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 84%) nucleotide sequence of VGAM359 RNA is designated SEQ ID:694, and is provided hereinbelow with reference to the sequence listing part.

VGAM359 host target gene, herein designated VGAM HOST TARGET GENE, encodes a corresponding messenger RNA, VGAM359 host target RNA, herein designated VGAM HOST TARGET RNA. VGAM359 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM359 RNA, herein designated VGAM RNA, binds complementarily to one or more host target binding sites located in untranslated regions of VGAM359 host target RNA, herein designated VGAM HOST TARGET RNA. This complementary binding is due to the fact that the nucleotide sequence of VGAM359 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting. VGAM359 RNA, herein designated VGAM RNA, may have a different number of host target binding sites in untranslated regions of a VGAM359 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM359 RNA, herein designated VGAM RNA, to host target binding sites on VGAM359 host target RNA, herein designated VGAM HOST TARGET RNA, such as BINDING SITE I, BINDING SITE II and BINDING SITE III, inhibits translation of VGAM359 host target RNA, herein designated VGAM HOST TARGET RNA, into VGAM359 host target protein, herein designated VGAM HOST TARGET PROTEIN. VGAM host target protein is therefore outlined by a broken line.

It is appreciated that VGAM359 host target gene, herein designated VGAM HOST TARGET GENE, in fact represents a plurality of VGAM359 host target genes. The mRNA of each one of this plurality of VGAM359 host target genes comprises one or more host target binding sites, each having a nucleotide sequence which is at least partly complementary to VGAM359 RNA, herein designated VGAM RNA, and which when bound by VGAM359 RNA, herein designated VGAM RNA, causes inhibition of translation of respective one or more VGAM359 host target proteins.

It is further appreciated by one skilled in the art that the mode of translational inhibition illustrated by FIG. 1 with specific reference to translational inhibition exerted by VGAM359 gene, herein designated VGAM GENE, on one or more VGAM359 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM359 is inhibition of expression of host target genes, as part of a novel viral mechanism of attacking a host. Accordingly, utilities of VGAM359 include diagnosis, prevention and treatment of viral infection by Vaccinia virus. Specific functions, and accordingly utilities, of VGAM359 correlate with, and may be deduced from, the identity of the host target genes which VGAM359 binds and inhibits, and the function of these host target genes, as elaborated hereinbelow.

Nucleotide sequences of the VGAM359 precursor RNA, herein designated VGAM PRECURSOR RNA, and of the diced VGAM359 RNA, herein designated VGAM RNA, and a schematic representation of the secondary folding of VGAM359 folded precursor RNA, herein designated VGAM FOLDED PRECURSOR RNA, of VGAM359 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM359 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 360 (VGAM360) viral gene, which modulates expression of respective host target genes thereof, the function and utility of which host target genes is known in the art.

VGAM360 is a novel bioinformatically detected regulatory, non protein coding, viral micro RNA (miRNA) gene. The method by which VGAM360 was detected is described hereinabove with reference to FIGS. 2-8.

VGAM360 gene, herein designated VGAM GENE, is a viral gene contained in the genome of Vaccinia virus. VGAM360 host target gene, herein designated VGAM HOST TARGET GENE, is a human gene contained in the human genome.

VGAM360 gene, herein designated VGAM GENE, encodes a VGAM360 precursor RNA, herein designated VGAM PRECURSOR RNA. Similar to other miRNA genes, and unlike most ordinary genes, VGAM360 precursor RNA, herein designated VGAM PRECURSOR RNA, does not encode a protein. A nucleotide sequence identical or highly similar to the nucleotide sequence of VGAM360 precursor RNA is designated SEQ ID:346, and is provided hereinbelow with reference to the sequence listing part. Nucleotide sequence SEQ ID:346 is located at position 180452 relative to the genome of Vaccinia virus.

VGAM360 precursor RNA, herein designated VGAM PRECURSOR RNA, folds onto itself, forming VGAM360 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM360 folded precursor RNA, herein designated VGAM FOLDED PRECURSOR RNA, into VGAM360 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 85%) nucleotide sequence of VGAM360 RNA is designated SEQ ID:695, and is provided hereinbelow with reference to the sequence listing part.

VGAM360 host target gene, herein designated VGAM HOST TARGET GENE, encodes a corresponding messenger RNA, VGAM360 host target RNA, herein designated VGAM HOST TARGET RNA. VGAM360 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM360 RNA, herein designated VGAM RNA, binds complementarily to one or more host target binding sites located in untranslated regions of VGAM360 host target RNA, herein designated VGAM HOST TARGET RNA. This complementary binding is due to the fact that the nucleotide sequence of VGAM360 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM360 RNA, herein designated VGAM RNA, may have a different number of host target binding sites in untranslated regions of a VGAM360 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM360 RNA, herein designated VGAM RNA, to host target binding sites on VGAM360 host target RNA, herein designated VGAM HOST TARGET RNA, such as BINDING SITE I, BINDING SITE II and BINDING SITE III, inhibits translation of VGAM360 host target RNA, herein designated VGAM HOST TARGET RNA, into VGAM360 host target protein, herein designated VGAM HOST TARGET PROTEIN. VGAM host target protein is therefore outlined by a broken line.

It is appreciated that VGAM360 host target gene, herein designated VGAM HOST TARGET GENE, in fact represents a plurality of VGAM360 host target genes. The mRNA of each one of this plurality of VGAM360 host target genes comprises one or more host target binding sites, each having a nucleotide sequence which is at least partly complementary to VGAM360 RNA, herein designated VGAM RNA, and which when bound by VGAM360 RNA, herein designated VGAM RNA, causes inhibition of translation of respective one or more VGAM360 host target proteins.

It is further appreciated by one skilled in the art that the mode of translational inhibition illustrated by FIG. 1 with specific reference to translational inhibition exerted by VGAM360 gene, herein designated VGAM GENE, on one or more VGAM360 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM360 is inhibition of expression of host target genes, as part of a novel viral mechanism of attacking a host. Accordingly, utilities of VGAM360 include diagnosis, prevention and treatment of viral infection by Vaccinia virus. Specific functions, and accordingly utilities, of VGAM360 correlate with, and may be deduced from, the identity of the host target genes which VGAM360 binds and inhibits, and the function of these host target genes, as elaborated hereinbelow.

Nucleotide sequences of the VGAM360 precursor RNA, herein designated VGAM PRECURSOR RNA, and of the diced VGAM360 RNA, herein designated VGAM RNA, and a schematic representation of the secondary folding of VGAM360 folded precursor RNA, herein designated VGAM FOLDED PRECURSOR RNA, of VGAM360 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM360 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 361 (VGAM361) viral gene, which modulates expression of respective host target genes thereof, the function and utility of which host target genes is known in the art.

VGAM361 is a novel bioinformatically detected regulatory, non protein coding, viral micro RNA (miRNA) gene. The method by which VGAM361 was detected is described hereinabove with reference to FIGS. 2-8.

VGAM361 gene, herein designated VGAM GENE, is a viral gene contained in the genome of Vaccinia virus. VGAM361 host target gene, herein designated VGAM HOST TARGET GENE, is a human gene contained in the human genome.

VGAM361 gene, herein designated VGAM GENE, encodes a VGAM361 precursor RNA, herein designated VGAM PRECURSOR RNA. Similar to other miRNA genes, and unlike most ordinary genes, VGAM361 precursor RNA, herein designated VGAM PRECURSOR RNA, does not encode a protein. A nucleotide sequence identical or highly similar to the nucleotide sequence of VGAM361 precursor RNA is designated SEQ ID:347, and is provided hereinbelow with reference to the sequence listing part. Nucleotide sequence SEQ ID:347 is located at position 183817 relative to the genome of Vaccinia virus.

VGAM361 precursor RNA, herein designated VGAM PRECURSOR RNA, folds onto itself, forming VGAM361 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM361 folded precursor RNA, herein designated VGAM FOLDED PRECURSOR RNA, into VGAM361 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 80%) nucleotide sequence of VGAM361 RNA is designated SEQ ID:696, and is provided hereinbelow with reference to the sequence listing part.

VGAM361 host target gene, herein designated VGAM HOST TARGET GENE, encodes a corresponding messenger RNA, VGAM361 host target RNA, herein designated VGAM HOST TARGET RNA. VGAM361 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM361 RNA, herein designated VGAM RNA, binds complementarily to one or more host target binding sites located in untranslated regions of VGAM361 host target RNA, herein designated VGAM HOST TARGET RNA. This complementary binding is due to the fact that the nucleotide sequence of VGAM361 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM361 RNA, herein designated VGAM RNA, may have a different number of host target binding sites in untranslated regions of a VGAM361 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM361 RNA, herein designated VGAM RNA, to host target binding sites on VGAM361 host target RNA, herein designated VGAM HOST TARGET RNA, such as BINDING SITE I, BINDING SITE II and BINDING SITE III, inhibits translation of VGAM361 host target RNA, herein designated VGAM HOST TARGET RNA, into VGAM361 host target protein, herein designated VGAM HOST TARGET PROTEIN. VGAM host target protein is therefore outlined by a broken line.

It is appreciated that VGAM361 host target gene, herein designated VGAM HOST TARGET GENE, in fact represents a plurality of VGAM361 host target genes. The mRNA of each one of this plurality of VGAM361 host target genes comprises one or more host target binding sites, each having a nucleotide sequence which is at least partly complementary to VGAM361 RNA, herein designated VGAM RNA, and which when bound by VGAM361 RNA, herein designated VGAM RNA, causes inhibition of translation of respective one or more VGAM361 host target proteins.

It is further appreciated by one skilled in the art that the mode of translational inhibition illustrated by FIG. 1 with specific reference to translational inhibition exerted by VGAM361 gene, herein designated VGAM GENE, on one or more VGAM361 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM361 is inhibition of expression of host target genes, as part of a novel viral mechanism of attacking a host. Accordingly, utilities of VGAM361 include diagnosis, prevention and treatment of viral infection by Vaccinia virus. Specific functions, and accordingly utilities, of VGAM361 correlate with, and may be deduced from, the identity of the host target genes which VGAM361 binds and inhibits, and the function of these host target genes, as elaborated hereinbelow.

Nucleotide sequences of the VGAM361 precursor RNA, herein designated VGAM PRECURSOR RNA, and of the diced VGAM361 RNA, herein designated VGAM RNA, and a schematic representation of the secondary folding of VGAM361 folded precursor RNA, herein designated VGAM FOLDED PRECURSOR RNA, of VGAM361 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM361 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 362 (VGAM362) viral gene, which modulates expression of respective host target genes thereof, the function and utility of which host target genes is known in the art.

VGAM362 is a novel bioinformatically detected regulatory, non protein coding, viral micro RNA (miRNA) gene. The method by which VGAM362 was detected is described hereinabove with reference to FIGS. 2-8.

VGAM362 gene, herein designated VGAM GENE, is a viral gene contained in the genome of Vaccinia virus. VGAM362 host target gene, herein designated VGAM HOST TARGET GENE, is a human gene contained in the human genome.

VGAM362 gene, herein designated VGAM GENE, encodes a VGAM362 precursor RNA, herein designated VGAM PRECURSOR RNA. Similar to other miRNA genes, and unlike most ordinary genes, VGAM362 precursor RNA, herein designated VGAM PRECURSOR RNA, does not encode a protein. A nucleotide sequence identical or highly similar to the nucleotide sequence of VGAM362 precursor RNA is designated SEQ ID:348, and is provided hereinbelow with reference to the sequence listing part. Nucleotide sequence SEQ ID:348 is located at position 183735 relative to the genome of Vaccinia virus.

VGAM362 precursor RNA, herein designated VGAM PRECURSOR RNA, folds onto itself, forming VGAM362 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM362 folded precursor RNA, herein designated VGAM FOLDED PRECURSOR RNA, into VGAM362 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 71%) nucleotide sequence of VGAM362 RNA is designated SEQ ID:697, and is provided hereinbelow with reference to the sequence listing part.

VGAM362 host target gene, herein designated VGAM HOST TARGET GENE, encodes a corresponding messenger RNA, VGAM362 host target RNA, herein designated VGAM HOST TARGET RNA. VGAM362 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM362 RNA, herein designated VGAM RNA, binds complementarily to one or more host target binding sites located in untranslated regions of VGAM362 host target RNA, herein designated VGAM HOST TARGET RNA. This complementary binding is due to the fact that the nucleotide sequence of VGAM362 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM362 RNA, herein designated VGAM RNA, may have a different number of host target binding sites in untranslated regions of a VGAM362 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM362 RNA, herein designated VGAM RNA, to host target binding sites on VGAM362 host target RNA, herein designated VGAM HOST TARGET RNA, such as BINDING SITE I, BINDING SITE II and BINDING SITE III, inhibits translation of VGAM362 host target RNA, herein designated VGAM HOST TARGET RNA, into VGAM362 host target protein, herein designated VGAM HOST TARGET PROTEIN. VGAM host target protein is therefore outlined by a broken line.

It is appreciated that VGAM362 host target gene, herein designated VGAM HOST TARGET GENE, in fact represents a plurality of VGAM362 host target genes. The mRNA of each one of this plurality of VGAM362 host target genes comprises one or more host target binding sites, each having a nucleotide sequence which is at least partly complementary to VGAM362 RNA, herein designated VGAM RNA, and which when bound by VGAM362 RNA, herein designated VGAM RNA, causes inhibition of translation of respective one or more VGAM362 host target proteins.

It is further appreciated by one skilled in the art that the mode of translational inhibition illustrated by FIG. 1 with specific reference to translational inhibition exerted by VGAM362 gene, herein designated VGAM GENE, on one or more VGAM362 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM362 is inhibition of expression of host target genes, as part of a novel viral mechanism of attacking a host. Accordingly, utilities of VGAM362 include diagnosis, prevention and treatment of viral infection by Vaccinia virus. Specific functions, and accordingly utilities, of VGAM362 correlate with, and may be deduced from, the identity of the host target genes which VGAM362 binds and inhibits, and the function of these host target genes, as elaborated hereinbelow.

Nucleotide sequences of the VGAM362 precursor RNA, herein designated VGAM PRECURSOR RNA, and of the diced VGAM362 RNA, herein designated VGAM RNA, and a schematic representation of the secondary folding of VGAM362 folded precursor RNA, herein designated VGAM FOLDED PRECURSOR RNA, of VGAM362 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM362 RNA, herein designated VGAM RNA, are described hereinbelow with reference to Table 2.

FIG. 1 further provides a conceptual description of another novel bioinformatically detected viral gene of the present invention, referred to here as Viral Genomic Address Messenger 363 (VGAM363) viral gene, which modulates expression of respective host target genes thereof, the function and utility of which host target genes is known in the art.

VGAM363 is a novel bioinformatically detected regulatory, non protein coding, viral micro RNA (miRNA) gene. The method by which VGAM363 was detected is described hereinabove with reference to FIGS. 2-8.

VGAM363 gene, herein designated VGAM GENE, is a viral gene contained in the genome of Vaccinia virus. VGAM363 host target gene, herein designated VGAM HOST TARGET GENE, is a human gene contained in the human genome.

VGAM363 gene, herein designated VGAM GENE, encodes a VGAM363 precursor RNA, herein designated VGAM PRECURSOR RNA. Similar to other miRNA genes, and unlike most ordinary genes, VGAM363 precursor RNA, herein designated VGAM PRECURSOR RNA, does not encode a protein. A nucleotide sequence identical or highly similar to the nucleotide sequence of VGAM363 precursor RNA is designated SEQ ID:349, and is provided hereinbelow with reference to the sequence listing part. Nucleotide sequence SEQ ID:349 is located at position 185510 relative to the genome of Vaccinia virus.

VGAM363 precursor RNA, herein designated VGAM PRECURSOR RNA, folds onto itself, forming VGAM363 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM363 folded precursor RNA, herein designated VGAM FOLDED PRECURSOR RNA, into VGAM363 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 87%) nucleotide sequence of VGAM363 RNA is designated SEQ ID:698, and is provided hereinbelow with reference to the sequence listing part.

VGAM363 host target gene, herein designated VGAM HOST TARGET GENE, encodes a corresponding messenger RNA, VGAM363 host target RNA, herein designated VGAM HOST TARGET RNA. VGAM363 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM363 RNA, herein designated VGAM RNA, binds complementarily to one or more host target binding sites located in untranslated regions of VGAM363 host target RNA, herein designated VGAM HOST TARGET RNA. This complementary binding is due to the fact that the nucleotide sequence of VGAM363 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM363 RNA, herein designated VGAM RNA, may have a different number of host target binding sites in untranslated regions of a VGAM363 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM363 RNA, herein designated VGAM RNA, to host target binding sites on VGAM363 host target RNA, herein designated VGAM HOST TARGET RNA, such as BINDING SITE I, BINDING SITE II and BINDING SITE III, inhibits translation of VGAM363 host target RNA, herein designated VGAM HOST TARGET RNA, into VGAM363 host target protein, herein designated VGAM HOST TARGET PROTEIN. VGAM host target protein is therefore outlined by a broken line.

It is appreciated that VGAM363 host target gene, herein designated VGAM HOST TARGET GENE, in fact represents a plurality of VGAM363 host target genes. The mRNA of each one of this plurality of VGAM363 host target genes comprises one or more host target binding sites, each having a nucleotide sequence which is at least partly complementary to VGAM363 RNA, herein designated VGAM RNA, and which when bound by VGAM363 RNA, herein designated VGAM RNA, causes inhibition of translation of respective one or more VGAM363 host target proteins.

It is further appreciated by one skilled in the art that the mode of translational inhibition illustrated by FIG. 1 with specific reference to translational inhibition exerted by VGAM363 gene, herein designated VGAM GENE, on one or more VGAM363 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM363 is inhibition of expression of host target genes, as part of a novel viral mechanism of attacking a host. Accordingly, utilities of VGAM363 include diagnosis, prevention and treatment of viral infection by Vaccinia virus. Specific functions, and accordingly utilities, of VGAM363 correlate with, and may be deduced from, the identity of the host target genes which VGAM363 binds and inhibits, and the function of these host target genes, as elaborated hereinbelow.

Nucleotide sequences of the VGAM363 precursor RNA, herein designated VGAM PRECURSOR RNA, and of the diced VGAM363 RNA, herein designated VGAM RNA, and a schematic representation of the secondary folding of VGAM363 folded precursor RNA, herein designated VGAM FOLDED PRECURSOR RNA, of VGAM363 are further described hereinbelow with reference to Table 1.

Nucleotide sequences of host target binding sites, such as BINDING SITE-I, BINDING SITE-II and BINDING SITE-III of FIG. 1, found on, and schematic representation of the complementarity of each of these host target binding sites to VGAM363 RNA, herein designated VGAM RNA, are described hereinbelow with reference to Table 2.

FIG. 9 further provides a conceptual description of novel bioinformatically detected regulatory viral gene, referred to here as Viral Genomic Record 364(VGR364) viral gene, which encodes an operon-like cluster of novel viral micro RNA-like genes, each of which in turn modulates expression of at least one host target gene, the function and utility of which at least one host target gene is known in the art.

VGR364 gene, herein designated VGR GENE, is a novel bioinformatically detected regulatory, non protein coding, RNA viral gene. The method by which VGR364 gene was detected is described hereinabove with reference to FIGS. 6-15.

VGR364 gene encodes VGR364 precursor RNA, herein designated VGR PRECURSOR RNA, an RNA molecule, typically several hundred nucleotides long.

VGR364 precursor RNA folds spatially, forming VGR364 folded precursor RNA, herein designated VGR FOLDED PRECURSOR RNA. It is appreciated that VGR364 folded precursor RNA, herein designated VGR FOLDED PRECURSOR RNA, comprises a plurality of what is known in the art as hairpin structures. These hairpin structures are due to the fact that the nucleotide sequence of VGR364 precursor RNA comprises a plurality of segments, the first half of each such segment having a nucleotide sequence which is at least a partial inversed-reversed sequence of the second half thereof, as is well known in the art.

VGR364 folded precursor RNA, herein designated VGR FOLDED PRECURSOR RNA, is naturally processed by cellular enzymatic activity into at least 8 separate VGAM precursor RNAs, VGAM15 precursor RNA, VGAM16 precursor RNA, VGAM17 precursor RNA, VGAM18 precursor RNA, VGAM19 precursor RNA, VGAM20 precursor RNA, VGAM21 precursor RNA and VGAM22 precursor RNA, herein schematically represented by VGAM1 PRECURSOR, VGAM2 PRECURSOR, VGAM3 PRECURSOR, VGAM4 PRECURSOR, VGAM5 PRECURSOR, VGAM6 PRECURSOR, VGAM7 PRECURSOR and VGAM8 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM15 RNA, VGAM16 RNA, VGAM17 RNA, VGAM18 RNA, VGAM19 RNA, VGAM20 RNA, VGAM21 RNA and VGAM22 RNA respectively, herein schematically represented by VGAM1 RNA, VGAM2 RNA, VGAM3 RNA, VGAM4 RNA, VGAM5 RNA, VGAM6 RNA, VGAM7 RNA and VGAM8 RNA respectively, each of which VGAM RNAs corresponding to VGAM RNA of FIG. 8.

VGAM15 RNA, herein schematically represented by VGAM1 binds complimentarily to a host target binding site located in an untranslated region of VGAM15 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM15 host target RNA, herein schematically represented by VGAM1 HOST TARGET RNA into VGAM15 host target protein, herein schematically represented by VGAM1 HOST TARGET PROTEIN, both of FIG. 1.

VGAM16 RNA, herein schematically represented by VGAM2 binds complimentarily to a host target binding site located in an untranslated region of VGAM16 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM16 host target RNA, herein schematically represented by VGAM2 HOST TARGET RNA into VGAM16 host target protein, herein schematically represented by VGAM2 HOST TARGET PROTEIN, both of FIG. 1.

VGAM17 RNA, herein schematically represented by VGAM3 binds complimentarily to a host target binding site located in an untranslated region of VGAM17 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM17 host target RNA, herein schematically represented by VGAM3 HOST TARGET RNA into VGAM17 host target protein, herein schematically represented by VGAM3 HOST TARGET PROTEIN, both of FIG. 1.

VGAM18 RNA, herein schematically represented by VGAM4 binds complimentarily to a host target binding site located in an untranslated region of VGAM18 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM18 host target RNA, herein schematically represented by VGAM4 HOST TARGET RNA into VGAM18 host target protein, herein schematically represented by VGAM4 HOST TARGET PROTEIN, both of FIG. 1.

VGAM19 RNA, herein schematically represented by VGAM5 binds complimentarily to a host target binding site located in an untranslated region of VGAM19 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM19 host target RNA, herein schematically represented by VGAM5 HOST TARGET RNA into VGAM19 host target protein, herein schematically represented by VGAM5 HOST TARGET PROTEIN, both of FIG. 1.

VGAM20 RNA, herein schematically represented by VGAM6 binds complimentarily to a host target binding site located in an untranslated region of VGAM20 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM20 host target RNA, herein schematically represented by VGAM6 HOST TARGET RNA into VGAM20 host target protein, herein schematically represented by VGAM6 HOST TARGET PROTEIN, both of FIG. 1.

VGAM21 RNA, herein schematically represented by VGAM7 binds complimentarily to a host target binding site located in an untranslated region of VGAM21 host target RNA, herein schematically represented by VGAM7 HOST TARGET RNA, which host target binding site corresponds to a host target binding site such as BINDING SITE I, BINDING SITE II or BINDING SITE III of FIG. 1, thereby inhibiting translation of VGAM21 host target RNA, herein schematically represented by VGAM7 HOST TARGET RNA into VGAM21 host target protein, herein schematically represented by VGAM7 HOST TARGET PROTEIN, both of FIG. 1.

VGAM22 RNA, herein schematically represented by VGAM8 binds complimentarily to a host target binding site located in an untranslated region of VGAM22 host target RNA, herein schematically represented by VGAM8 HOST TARGET RNA, which host target binding site corresponds to a host target binding site such as BINDING SITE I, BINDING SITE II or BINDING SITE III of FIG. 1, thereby inhibiting translation of VGAM22 host target RNA, herein schematically represented by VGAM8 HOST TARGET RNA into VGAM22 host target protein, herein schematically represented by VGAM8 HOST TARGET PROTEIN, both of FIG. 1.

It is appreciated that a function of VGR364 gene, herein designated VGR GENE, is inhibition of expression of host target genes, as part of a novel viral mechanism of attacking a host. Accordingly, utilities of VGR364 gene include diagnosis, prevention and treatment of viral infection by. Specific functions, and accordingly utilities, of VGR364 gene, herein designated VGR GENE, correlate with, and may be deduced from, the identity of the host target genes, which are inhibited by VGAM RNAs comprised in the operon-like cluster of VGR364 gene: VGAM15 host target protein, VGAM16 host target protein, VGAM17 host target protein, VGAM18 host target protein, VGAM19 host target protein, VGAM20 host target protein, VGAM21 host target protein and VGAM22 host target protein, herein schematically represented by VGAM1 HOST TARGET PROTEIN through VGAM HOST TARGET PROTEIN respectively. The function of these host target genes is elaborated hereinabove with reference to VGAM15, VGAM16, VGAM17, VGAM18, VGAM19, VGAM20, VGAM21 and VGAM22

FIG. 9 further provides a conceptual description of novel bioinformatically detected regulatory viral gene, referred to here as Viral Genomic Record 365(VGR365) viral gene, which encodes an operon-like cluster of novel viral micro RNA-like genes, each of which in turn modulates expression of at least one host target gene, the function and utility of which at least one host target gene is known in the art.

VGR365 gene, herein designated VGR GENE, is a novel bioinformatically detected regulatory, non protein coding, RNA viral gene. The method by which VGR365 gene was detected is described hereinabove with reference to FIGS. 6-15.

VGR365 gene encodes VGR365 precursor RNA, herein designated VGR PRECURSOR RNA, an RNA molecule, typically several hundred nucleotides long.

VGR365 precursor RNA folds spatially, forming VGR365 folded precursor RNA, herein designated VGR FOLDED PRECURSOR RNA. It is appreciated that VGR365 folded precursor RNA, herein designated VGR FOLDED PRECURSOR RNA, comprises a plurality of what is known in the art as hairpin structures. These hairpin structures are due to the fact that the nucleotide sequence of VGR365 precursor RNA comprises a plurality of segments, the first half of each such segment having a nucleotide sequence which is at least a partial inversed-reversed sequence of the second half thereof, as is well known in the art.

VGR365 folded precursor RNA, herein designated VGR FOLDED PRECURSOR RNA, is naturally processed by cellular enzymatic activity into at least 8 separate VGAM precursor RNAs, VGAM23 precursor RNA, VGAM24 precursor RNA, VGAM25 precursor RNA, VGAM26 precursor RNA, VGAM27 precursor RNA, VGAM28 precursor RNA, VGAM29 precursor RNA and VGAM30 precursor RNA, herein schematically represented by VGAM1 PRECURSOR, VGAM2 PRECURSOR, VGAM3 PRECURSOR, VGAM4 PRECURSOR, VGAM5 PRECURSOR, VGAM6 PRECURSOR, VGAM7 PRECURSOR and VGAM8 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM23 RNA, VGAM24 RNA, VGAM25 RNA, VGAM26 RNA, VGAM27 RNA, VGAM28 RNA, VGAM29 RNA and VGAM30 RNA respectively, herein schematically represented by VGAM1 RNA, VGAM2 RNA, VGAM3 RNA, VGAM4 RNA, VGAM5 RNA, VGAM6 RNA, VGAM7 RNA and VGAM8 RNA respectively, each of which VGAM RNAs corresponding to VGAM RNA of FIG. 8.

VGAM23 RNA, herein schematically represented by VGAM1 binds complimentarily to a host target binding site located in an untranslated region of VGAM23 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM23 host target RNA, herein schematically represented by VGAM1 HOST TARGET RNA into VGAM23 host target protein, herein schematically represented by VGAM1 HOST TARGET PROTEIN, both of FIG. 1.

VGAM24 RNA, herein schematically represented by VGAM2 binds complimentarily to a host target binding site located in an untranslated region of VGAM24 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM24 host target RNA, herein schematically represented by VGAM2 HOST TARGET RNA into VGAM24 host target protein, herein schematically represented by VGAM2 HOST TARGET PROTEIN, both of FIG. 1.

VGAM25 RNA, herein schematically represented by VGAM3 binds complimentarily to a host target binding site located in an untranslated region of VGAM25 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM25 host target RNA, herein schematically represented by VGAM3 HOST TARGET RNA into VGAM25 host target protein, herein schematically represented by VGAM3 HOST TARGET PROTEIN, both of FIG. 1.

VGAM26 RNA, herein schematically represented by VGAM4 binds complimentarily to a host target binding site located in an untranslated region of VGAM26 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM26 host target RNA, herein schematically represented by VGAM4 HOST TARGET RNA into VGAM26 host target protein, herein schematically represented by VGAM4 HOST TARGET PROTEIN, both of FIG. 1.

VGAM27 RNA, herein schematically represented by VGAM5 binds complimentarily to a host target binding site located in an untranslated region of VGAM27 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM27 host target RNA, herein schematically represented by VGAM5 HOST TARGET RNA into VGAM27 host target protein, herein schematically represented by VGAM5 HOST TARGET PROTEIN, both of FIG. 1.

VGAM28 RNA, herein schematically represented by VGAM6 binds complimentarily to a host target binding site located in an untranslated region of VGAM28 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM28 host target RNA, herein schematically represented by VGAM6 HOST TARGET RNA into VGAM28 host target protein, herein schematically represented by VGAM6 HOST TARGET PROTEIN, both of FIG. 1.

VGAM29 RNA, herein schematically represented by VGAM7 binds complimentarily to a host target binding site located in an untranslated region of VGAM29 host target RNA, herein schematically represented by VGAM7 HOST TARGET RNA, which host target binding site corresponds to a host target binding site such as BINDING SITE I, BINDING SITE II or BINDING SITE III of FIG. 1, thereby inhibiting translation of VGAM29 host target RNA, herein schematically represented by VGAM7 HOST TARGET RNA into VGAM29 host target protein, herein schematically represented by VGAM7 HOST TARGET PROTEIN, both of FIG. 1.

VGAM30 RNA, herein schematically represented by VGAM8 binds complimentarily to a host target binding site located in an untranslated region of VGAM30 host target RNA, herein schematically represented by VGAM8 HOST TARGET RNA, which host target binding site corresponds to a host target binding site such as BINDING SITE I, BINDING SITE II or BINDING SITE III of FIG. 1, thereby inhibiting translation of VGAM30 host target RNA, herein schematically represented by VGAM8 HOST TARGET RNA into VGAM30 host target protein, herein schematically represented by VGAM8 HOST TARGET PROTEIN, both of FIG. 1.

It is appreciated that a function of VGR365 gene, herein designated VGR GENE, is inhibition of expression of host target genes, as part of a novel viral mechanism of attacking a host. Accordingly, utilities of VGR365 gene include diagnosis, prevention and treatment of viral infection by. Specific functions, and accordingly utilities, of VGR365 gene, herein designated VGR GENE, correlate with, and may be deduced from, the identity of the host target genes, which are inhibited by VGAM RNAs comprised in the operon-like cluster of VGR365 gene: VGAM23 host target protein, VGAM24 host target protein, VGAM25 host target protein, VGAM26 host target protein, VGAM27 host target protein, VGAM28 host target protein, VGAM29 host target protein and VGAM30 host target protein, herein schematically represented by VGAM1 HOST TARGET PROTEIN through VGAM HOST TARGET PROTEIN respectively. The function of these host target genes is elaborated hereinabove with reference to VGAM23, VGAM24, VGAM25, VGAM26, VGAM27, VGAM28, VGAM29 and VGAM30

FIG. 9 further provides a conceptual description of novel bioinformatically detected regulatory viral gene, referred to here as Viral Genomic Record 366(VGR366) viral gene, which encodes an operon-like cluster of novel viral micro RNA-like genes, each of which in turn modulates expression of at least one host target gene, the function and utility of which at least one host target gene is known in the art.

VGR366 gene, herein designated VGR GENE, is a novel bioinformatically detected regulatory, non protein coding, RNA viral gene. The method by which VGR366 gene was detected is described hereinabove with reference to FIGS. 6-15.

VGR366 gene encodes VGR366 precursor RNA, herein designated VGR PRECURSOR RNA, an RNA molecule, typically several hundred nucleotides long.

VGR366 precursor RNA folds spatially, forming VGR366 folded precursor RNA, herein designated VGR FOLDED PRECURSOR RNA. It is appreciated that VGR366 folded precursor RNA, herein designated VGR FOLDED PRECURSOR RNA, comprises a plurality of what is known in the art as hairpin structures. These hairpin structures are due to the fact that the nucleotide sequence of VGR366 precursor RNA comprises a plurality of segments, the first half of each such segment having a nucleotide sequence which is at least a partial inversed-reversed sequence of the second half thereof, as is well known in the art.

VGR366 folded precursor RNA, herein designated VGR FOLDED PRECURSOR RNA, is naturally processed by cellular enzymatic activity into at least 4 separate VGAM precursor RNAs, VGAM31 precursor RNA, VGAM32 precursor RNA, VGAM33 precursor RNA and VGAM34 precursor RNA, herein schematically represented by VGAM1 PRECURSOR, VGAM2 PRECURSOR, VGAM3 PRECURSOR and VGAM4 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM31 RNA, VGAM32 RNA, VGAM33 RNA and VGAM34 RNA respectively, herein schematically represented by VGAM1 RNA, VGAM2 RNA, VGAM3 RNA and VGAM4 RNA respectively, each of which VGAM RNAs corresponding to VGAM RNA of FIG. 8.

VGAM31 RNA, herein schematically represented by VGAM1 binds complimentarily to a host target binding site located in an untranslated region of VGAM31 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM31 host target RNA, herein schematically represented by VGAM1 HOST TARGET RNA into VGAM31 host target protein, herein schematically represented by VGAM1 HOST TARGET PROTEIN, both of FIG. 1.

VGAM32 RNA, herein schematically represented by VGAM2 binds complimentarily to a host target binding site located in an untranslated region of VGAM32 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM32 host target RNA, herein schematically represented by VGAM2 HOST TARGET RNA into VGAM32 host target protein, herein schematically represented by VGAM2 HOST TARGET PROTEIN, both of FIG. 1.

VGAM33 RNA, herein schematically represented by VGAM3 binds complimentarily to a host target binding site located in an untranslated region of VGAM33 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM33 host target RNA, herein schematically represented by VGAM3 HOST TARGET RNA into VGAM33 host target protein, herein schematically represented by VGAM3 HOST TARGET PROTEIN, both of FIG. 1.

VGAM34 RNA, herein schematically represented by VGAM4 binds complimentarily to a host target binding site located in an untranslated region of VGAM34 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM34 host target RNA, herein schematically represented by VGAM4 HOST TARGET RNA into VGAM34 host target protein, herein schematically represented by VGAM4 HOST TARGET PROTEIN, both of FIG. 1.

It is appreciated that a function of VGR366 gene, herein designated VGR GENE, is inhibition of expression of host target genes, as part of a novel viral mechanism of attacking a host. Accordingly, utilities of VGR366 gene include diagnosis, prevention and treatment of viral infection by. Specific functions, and accordingly utilities, of VGR366 gene, herein designated VGR GENE, correlate with, and may be deduced from, the identity of the host target genes, which are inhibited by VGAM RNAs comprised in the operon-like cluster of VGR366 gene: VGAM31 host target protein, VGAM32 host target protein, VGAM33 host target protein and VGAM34 host target protein, herein schematically represented by VGAM1 HOST TARGET PROTEIN through VGAM HOST TARGET PROTEIN respectively. The function of these host target genes is elaborated hereinabove with reference to VGAM31, VGAM32, VGAM33 and VGAM34

FIG. 9 further provides a conceptual description of novel bioinformatically detected regulatory viral gene, referred to here as Viral Genomic Record 367(VGR367) viral gene, which encodes an operon-like cluster of novel viral micro RNA-like genes, each of which in turn modulates expression of at least one host target gene, the function and utility of which at least one host target gene is known in the art.

VGR367 gene, herein designated VGR GENE, is a novel bioinformatically detected regulatory, non protein coding, RNA viral gene. The method by which VGR367 gene was detected is described hereinabove with reference to FIGS. 6-15.

VGR367 gene encodes VGR367 precursor RNA, herein designated VGR PRECURSOR RNA, an RNA molecule, typically several hundred nucleotides long.

VGR367 precursor RNA folds spatially, forming VGR367 folded precursor RNA, herein designated VGR FOLDED PRECURSOR RNA. It is appreciated that VGR367 folded precursor RNA, herein designated VGR FOLDED PRECURSOR RNA, comprises a plurality of what is known in the art as hairpin structures. These hairpin structures are due to the fact that the nucleotide sequence of VGR367 precursor RNA comprises a plurality of segments, the first half of each such segment having a nucleotide sequence which is at least a partial inversed-reversed sequence of the second half thereof, as is well known in the art.

VGR367 folded precursor RNA, herein designated VGR FOLDED PRECURSOR RNA, is naturally processed by cellular enzymatic activity into at least 8 separate VGAM precursor RNAs, VGAM35 precursor RNA, VGAM36 precursor RNA, VGAM37 precursor RNA, VGAM38 precursor RNA, VGAM39 precursor RNA, VGAM40 precursor RNA, VGAM41 precursor RNA and VGAM42 precursor RNA, herein schematically represented by VGAM1 PRECURSOR, VGAM2 PRECURSOR, VGAM3 PRECURSOR, VGAM4 PRECURSOR, VGAM5 PRECURSOR, VGAM6 PRECURSOR, VGAM7 PRECURSOR and VGAM8 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM35 RNA, VGAM36 RNA, VGAM37 RNA, VGAM38 RNA, VGAM39 RNA, VGAM40 RNA, VGAM41 RNA and VGAM42 RNA respectively, herein schematically represented by VGAM1 RNA, VGAM2 RNA, VGAM3 RNA, VGAM4 RNA, VGAM5 RNA, VGAM6 RNA, VGAM7 RNA and VGAM8 RNA respectively, each of which VGAM RNAs corresponding to VGAM RNA of FIG. 8.

VGAM35 RNA, herein schematically represented by VGAM1 binds complimentarily to a host target binding site located in an untranslated region of VGAM35 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM35 host target RNA, herein schematically represented by VGAM1 HOST TARGET RNA into VGAM35 host target protein, herein schematically represented by VGAM1 HOST TARGET PROTEIN, both of FIG. 1.

VGAM36 RNA, herein schematically represented by VGAM2 binds complimentarily to a host target binding site located in an untranslated region of VGAM36 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM36 host target RNA, herein schematically represented by VGAM2 HOST TARGET RNA into VGAM36 host target protein, herein schematically represented by VGAM2 HOST TARGET PROTEIN, both of FIG. 1.

VGAM37 RNA, herein schematically represented by VGAM3 binds complimentarily to a host target binding site located in an untranslated region of VGAM37 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM37 host target RNA, herein schematically represented by VGAM3 HOST TARGET RNA into VGAM37 host target protein, herein schematically represented by VGAM3 HOST TARGET PROTEIN, both of FIG. 1.

VGAM38 RNA, herein schematically represented by VGAM4 binds complimentarily to a host target binding site located in an untranslated region of VGAM38 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM38 host target RNA, herein schematically represented by VGAM4 HOST TARGET RNA into VGAM38 host target protein, herein schematically represented by VGAM4 HOST TARGET PROTEIN, both of FIG. 1.

VGAM39 RNA, herein schematically represented by VGAM5 binds complimentarily to a host target binding site located in an untranslated region of VGAM39 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM39 host target RNA, herein schematically represented by VGAM5 HOST TARGET RNA into VGAM39 host target protein, herein schematically represented by VGAM5 HOST TARGET PROTEIN, both of FIG. 1.

VGAM40 RNA, herein schematically represented by VGAM6 binds complimentarily to a host target binding site located in an untranslated region of VGAM40 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM40 host target RNA, herein schematically represented by VGAM6 HOST TARGET RNA into VGAM40 host target protein, herein schematically represented by VGAM6 HOST TARGET PROTEIN, both of FIG. 1.

VGAM41 RNA, herein schematically represented by VGAM7 binds complimentarily to a host target binding site located in an untranslated region of VGAM41 host target RNA, herein schematically represented by VGAM7 HOST TARGET RNA, which host target binding site corresponds to a host target binding site such as BINDING SITE I, BINDING SITE II or BINDING SITE III of FIG. 1, thereby inhibiting translation of VGAM41 host target RNA, herein schematically represented by VGAM7 HOST TARGET RNA into VGAM41 host target protein, herein schematically represented by VGAM7 HOST TARGET PROTEIN, both of FIG. 1.

VGAM42 RNA, herein schematically represented by VGAM8 binds complimentarily to a host target binding site located in an untranslated region of VGAM42 host target RNA, herein schematically represented by VGAM8 HOST TARGET RNA, which host target binding site corresponds to a host target binding site such as BINDING SITE I, BINDING SITE II or BINDING SITE III of FIG. 1, thereby inhibiting translation of VGAM42 host target RNA, herein schematically represented by VGAM8 HOST TARGET RNA into VGAM42 host target protein, herein schematically represented by VGAM8 HOST TARGET PROTEIN, both of FIG. 1.

It is appreciated that a function of VGR367 gene, herein designated VGR GENE, is inhibition of expression of host target genes, as part of a novel viral mechanism of attacking a host. Accordingly, utilities of VGR367 gene include diagnosis, prevention and treatment of viral infection by. Specific functions, and accordingly utilities, of VGR367 gene, herein designated VGR GENE, correlate with, and may be deduced from, the identity of the host target genes, which are inhibited by VGAM RNAs comprised in the operon-like cluster of VGR367 gene: VGAM35 host target protein, VGAM36 host target protein, VGAM37 host target protein, VGAM38 host target protein, VGAM39 host target protein, VGAM40 host target protein, VGAM41 host target protein and VGAM42 host target protein, herein schematically represented by VGAM1 HOST TARGET PROTEIN through VGAM HOST TARGET PROTEIN respectively. The function of these host target genes is elaborated hereinabove with reference to VGAM35, VGAM36, VGAM37, VGAM38, VGAM39, VGAM40, VGAM41 and VGAM42

FIG. 9 further provides a conceptual description of novel bioinformatically detected regulatory viral gene, referred to here as Viral Genomic Record 368(VGR368) viral gene, which encodes an operon-like cluster of novel viral micro RNA-like genes, each of which in turn modulates expression of at least one host target gene, the function and utility of which at least one host target gene is known in the art.

VGR368 gene, herein designated VGR GENE, is a novel bioinformatically detected regulatory, non protein coding, RNA viral gene. The method by which VGR368 gene was detected is described hereinabove with reference to FIGS. 6-15.

VGR368 gene encodes VGR368 precursor RNA, herein designated VGR PRECURSOR RNA, an RNA molecule, typically several hundred nucleotides long.

VGR368 precursor RNA folds spatially, forming VGR368 folded precursor RNA, herein designated VGR FOLDED PRECURSOR RNA. It is appreciated that VGR368 folded precursor RNA, herein designated VGR FOLDED PRECURSOR RNA, comprises a plurality of what is known in the art as hairpin structures. These hairpin structures are due to the fact that the nucleotide sequence of VGR368 precursor RNA comprises a plurality of segments, the first half of each such segment having a nucleotide sequence which is at least a partial inversed-reversed sequence of the second half thereof, as is well known in the art.

VGR368 folded precursor RNA, herein designated VGR FOLDED PRECURSOR RNA, is naturally processed by cellular enzymatic activity into at least 8 separate VGAM precursor RNAs, VGAM43 precursor RNA, VGAM44 precursor RNA, VGAM45 precursor RNA, VGAM46 precursor RNA, VGAM47 precursor RNA, VGAM48 precursor RNA, VGAM49 precursor RNA and VGAM50 precursor RNA, herein schematically represented by VGAM1 PRECURSOR, VGAM2 PRECURSOR, VGAM3 PRECURSOR, VGAM4 PRECURSOR, VGAM5 PRECURSOR, VGAM6 PRECURSOR, VGAM7 PRECURSOR and VGAM8 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM43 RNA, VGAM44 RNA, VGAM45 RNA, VGAM46 RNA, VGAM47 RNA, VGAM48 RNA, VGAM49 RNA and VGAM50 RNA respectively, herein schematically represented by VGAM1 RNA, VGAM2 RNA, VGAM3 RNA, VGAM4 RNA, VGAM5 RNA, VGAM6 RNA, VGAM7 RNA and VGAM8 RNA respectively, each of which VGAM RNAs corresponding to VGAM RNA of FIG. 8.

VGAM43 RNA, herein schematically represented by VGAM1 binds complimentarily to a host target binding site located in an untranslated region of VGAM43 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM43 host target RNA, herein schematically represented by VGAM1 HOST TARGET RNA into VGAM43 host target protein, herein schematically represented by VGAM1 HOST TARGET PROTEIN, both of FIG. 1.

VGAM44 RNA, herein schematically represented by VGAM2 binds complimentarily to a host target binding site located in an untranslated region of VGAM44 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM44 host target RNA, herein schematically represented by VGAM2 HOST TARGET RNA into VGAM44 host target protein, herein schematically represented by VGAM2 HOST TARGET PROTEIN, both of FIG. 1.

VGAM45 RNA, herein schematically represented by VGAM3 binds complimentarily to a host target binding site located in an untranslated region of VGAM45 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM45 host target RNA, herein schematically represented by VGAM3 HOST TARGET RNA into VGAM45 host target protein, herein schematically represented by VGAM3 HOST TARGET PROTEIN, both of FIG. 1.

VGAM46 RNA, herein schematically represented by VGAM4 binds complimentarily to a host target binding site located in an untranslated region of VGAM46 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM46 host target RNA, herein schematically represented by VGAM4 HOST TARGET RNA into VGAM46 host target protein, herein schematically represented by VGAM4 HOST TARGET PROTEIN, both of FIG. 1.

VGAM47 RNA, herein schematically represented by VGAM5 binds complimentarily to a host target binding site located in an untranslated region of VGAM47 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM47 host target RNA, herein schematically represented by VGAM5 HOST TARGET RNA into VGAM47 host target protein, herein schematically represented by VGAM5 HOST TARGET PROTEIN, both of FIG. 1.

VGAM48 RNA, herein schematically represented by VGAM6 binds complimentarily to a host target binding site located in an untranslated region of VGAM48 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM48 host target RNA, herein schematically represented by VGAM6 HOST TARGET RNA into VGAM48 host target protein, herein schematically represented by VGAM6 HOST TARGET PROTEIN, both of FIG. 1.

VGAM49 RNA, herein schematically represented by VGAM7 binds complimentarily to a host target binding site located in an untranslated region of VGAM49 host target RNA, herein schematically represented by VGAM7 HOST TARGET RNA, which host target binding site corresponds to a host target binding site such as BINDING SITE I, BINDING SITE II or BINDING SITE III of FIG. 1, thereby inhibiting translation of VGAM49 host target RNA, herein schematically represented by VGAM7 HOST TARGET RNA into VGAM49 host target protein, herein schematically represented by VGAM7 HOST TARGET PROTEIN, both of FIG. 1.

VGAM50 RNA, herein schematically represented by VGAM8 binds complimentarily to a host target binding site located in an untranslated region of VGAM50 host target RNA, herein schematically represented by VGAM8 HOST TARGET RNA, which host target binding site corresponds to a host target binding site such as BINDING SITE I, BINDING SITE II or BINDING SITE III of FIG. 1, thereby inhibiting translation of VGAM50 host target RNA, herein schematically represented by VGAM8 HOST TARGET RNA into VGAM50 host target protein, herein schematically represented by VGAM8 HOST TARGET PROTEIN, both of FIG. 1.

It is appreciated that a function of VGR368 gene, herein designated VGR GENE, is inhibition of expression of host target genes, as part of a novel viral mechanism of attacking a host. Accordingly, utilities of VGR368 gene include diagnosis, prevention and treatment of viral infection by. Specific functions, and accordingly utilities, of VGR368 gene, herein designated VGR GENE, correlate with, and may be deduced from, the identity of the host target genes, which are inhibited by VGAM RNAs comprised in the operon-like cluster of VGR368 gene: VGAM43 host target protein, VGAM44 host target protein, VGAM45 host target protein, VGAM46 host target protein, VGAM47 host target protein, VGAM48 host target protein, VGAM49 host target protein and VGAM50 host target protein, herein schematically represented by VGAM1 HOST TARGET PROTEIN through VGAM HOST TARGET PROTEIN respectively. The function of these host target genes is elaborated hereinabove with reference to VGAM43, VGAM44, VGAM45, VGAM46, VGAM47, VGAM48, VGAM49 and VGAM50

FIG. 9 further provides a conceptual description of novel bioinformatically detected regulatory viral gene, referred to here as Viral Genomic Record 369(VGR369) viral gene, which encodes an operon-like cluster of novel viral micro RNA-like genes, each of which in turn modulates expression of at least one host target gene, the function and utility of which at least one host target gene is known in the art.

VGR369 gene, herein designated VGR GENE, is a novel bioinformatically detected regulatory, non protein coding, RNA viral gene. The method by which VGR369 gene was detected is described hereinabove with reference to FIGS. 6-15.

VGR369 gene encodes VGR369 precursor RNA, herein designated VGR PRECURSOR RNA, an RNA molecule, typically several hundred nucleotides long.

VGR369 precursor RNA folds spatially, forming VGR369 folded precursor RNA, herein designated VGR FOLDED PRECURSOR RNA. It is appreciated that VGR369 folded precursor RNA, herein designated VGR FOLDED PRECURSOR RNA, comprises a plurality of what is known in the art as hairpin structures. These hairpin structures are due to the fact that the nucleotide sequence of VGR369 precursor RNA comprises a plurality of segments, the first half of each such segment having a nucleotide sequence which is at least a partial inversed-reversed sequence of the second half thereof, as is well known in the art.

VGR369 folded precursor RNA, herein designated VGR FOLDED PRECURSOR RNA, is naturally processed by cellular enzymatic activity into at least 4 separate VGAM precursor RNAs, VGAM51 precursor RNA, VGAM52 precursor RNA, VGAM53 precursor RNA and VGAM54 precursor RNA, herein schematically represented by VGAM1 PRECURSOR, VGAM2 PRECURSOR, VGAM3 PRECURSOR and VGAM4 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM51 RNA, VGAM52 RNA, VGAM53 RNA and VGAM54 RNA respectively, herein schematically represented by VGAM1 RNA, VGAM2 RNA, VGAM3 RNA and VGAM4 RNA respectively, each of which VGAM RNAs corresponding to VGAM RNA of FIG. 8.

VGAM51 RNA, herein schematically represented by VGAM1 binds complimentarily to a host target binding site located in an untranslated region of VGAM51 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM51 host target RNA, herein schematically represented by VGAM1 HOST TARGET RNA into VGAM51 host target protein, herein schematically represented by VGAM1 HOST TARGET PROTEIN, both of FIG. 1.

VGAM52 RNA, herein schematically represented by VGAM2 binds complimentarily to a host target binding site located in an untranslated region of VGAM52 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM52 host target RNA, herein schematically represented by VGAM2 HOST TARGET RNA into VGAM52 host target protein, herein schematically represented by VGAM2 HOST TARGET PROTEIN, both of FIG. 1.

VGAM53 RNA, herein schematically represented by VGAM3 binds complimentarily to a host target binding site located in an untranslated region of VGAM53 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM53 host target RNA, herein schematically represented by VGAM3 HOST TARGET RNA into VGAM53 host target protein, herein schematically represented by VGAM3 HOST TARGET PROTEIN, both of FIG. 1.

VGAM54 RNA, herein schematically represented by VGAM4 binds complimentarily to a host target binding site located in an untranslated region of VGAM54 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM54 host target RNA, herein schematically represented by VGAM4 HOST TARGET RNA into VGAM54 host target protein, herein schematically represented by VGAM4 HOST TARGET PROTEIN, both of FIG. 1.

It is appreciated that a function of VGR369 gene, herein designated VGR GENE, is inhibition of expression of host target genes, as part of a novel viral mechanism of attacking a host. Accordingly, utilities of VGR369 gene include diagnosis, prevention and treatment of viral infection by. Specific functions, and accordingly utilities, of VGR369 gene, herein designated VGR GENE, correlate with, and may be deduced from, the identity of the host target genes, which are inhibited by VGAM RNAs comprised in the operon-like cluster of VGR369 gene: VGAM51 host target protein, VGAM52 host target protein, VGAM53 host target protein and VGAM54 host target protein, herein schematically represented by VGAM1 HOST TARGET PROTEIN through VGAM HOST TARGET PROTEIN respectively. The function of these host target genes is elaborated hereinabove with reference to VGAM51, VGAM52, VGAM53 and VGAM54

FIG. 9 further provides a conceptual description of novel bioinformatically detected regulatory viral gene, referred to here as Viral Genomic Record 370(VGR370) viral gene, which encodes an operon-like cluster of novel viral micro RNA-like genes, each of which in turn modulates expression of at least one host target gene, the function and utility of which at least one host target gene is known in the art.

VGR370 gene, herein designated VGR GENE, is a novel bioinformatically detected regulatory, non protein coding, RNA viral gene. The method by which VGR370 gene was detected is described hereinabove with reference to FIGS. 6-15.

VGR370 gene encodes VGR370 precursor RNA, herein designated VGR PRECURSOR RNA, an RNA molecule, typically several hundred nucleotides long.

VGR370 precursor RNA folds spatially, forming VGR370 folded precursor RNA, herein designated VGR FOLDED PRECURSOR RNA. It is appreciated that VGR370 folded precursor RNA, herein designated VGR FOLDED PRECURSOR RNA, comprises a plurality of what is known in the art as hairpin structures. These hairpin structures are due to the fact that the nucleotide sequence of VGR370 precursor RNA comprises a plurality of segments, the first half of each such segment having a nucleotide sequence which is at least a partial inversed-reversed sequence of the second half thereof, as is well known in the art.

VGR370 folded precursor RNA, herein designated VGR FOLDED PRECURSOR RNA, is naturally processed by cellular enzymatic activity into at least 2 separate VGAM precursor RNAs, VGAM56 precursor RNA and VGAM57 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM56 RNA and VGAM57 RNA respectively, herein schematically represented by VGAM1 RNA and VGAM2 RNA respectively, each of which VGAM RNAs corresponding to VGAM RNA of FIG. 8.

VGAM56 RNA, herein schematically represented by VGAM1 binds complimentarily to a host target binding site located in an untranslated region of VGAM56 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM56 host target RNA, herein schematically represented by VGAM1 HOST TARGET RNA into VGAM56 host target protein, herein schematically represented by VGAM1 HOST TARGET PROTEIN, both of FIG. 1.

VGAM57 RNA, herein schematically represented by VGAM2 binds complimentarily to a host target binding site located in an untranslated region of VGAM57 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM57 host target RNA, herein schematically represented by VGAM2 HOST TARGET RNA into VGAM57 host target protein, herein schematically represented by VGAM2 HOST TARGET PROTEIN, both of FIG. 1.

It is appreciated that a function of VGR370 gene, herein designated VGR GENE, is inhibition of expression of host target genes, as part of a novel viral mechanism of attacking a host. Accordingly, utilities of VGR370 gene include diagnosis, prevention and treatment of viral infection by. Specific functions, and accordingly utilities, of VGR370 gene, herein designated VGR GENE, correlate with, and may be deduced from, the identity of the host target genes, which are inhibited by VGAM RNAs comprised in the operon-like cluster of VGR370 gene: VGAM56 host target protein and VGAM57 host target protein, herein schematically represented by VGAM1 HOST TARGET PROTEIN and VGAM HOST TARGET PROTEIN respectively. The function of these host target genes is elaborated hereinabove with reference to VGAM56 and VGAM57

FIG. 9 further provides a conceptual description of novel bioinformatically detected regulatory viral gene, referred to here as Viral Genomic Record 371(VGR371) viral gene, which encodes an operon-like cluster of novel viral micro RNA-like genes, each of which in turn modulates expression of at least one host target gene, the function and utility of which at least one host target gene is known in the art.

VGR371 gene, herein designated VGR GENE, is a novel bioinformatically detected regulatory, non protein coding, RNA viral gene. The method by which VGR371 gene was detected is described hereinabove with reference to FIGS. 6-15.

VGR371 gene encodes VGR371 precursor RNA, herein designated VGR PRECURSOR RNA, an RNA molecule, typically several hundred nucleotides long.

VGR371 precursor RNA folds spatially, forming VGR371 folded precursor RNA, herein designated VGR FOLDED PRECURSOR RNA. It is appreciated that VGR371 folded precursor RNA, herein designated VGR FOLDED PRECURSOR RNA, comprises a plurality of what is known in the art as hairpin structures. These hairpin structures are due to the fact that the nucleotide sequence of VGR371 precursor RNA comprises a plurality of segments, the first half of each such segment having a nucleotide sequence which is at least a partial inversed-reversed sequence of the second half thereof, as is well known in the art.

VGR371 folded precursor RNA, herein designated VGR FOLDED PRECURSOR RNA, is naturally processed by cellular enzymatic activity into at least 8 separate VGAM precursor RNAs, VGAM58 precursor RNA, VGAM59 precursor RNA, VGAM60 precursor RNA, VGAM61 precursor RNA, VGAM62 precursor RNA, VGAM63 precursor RNA, VGAM64 precursor RNA and VGAM65 precursor RNA, herein schematically represented by VGAM1 PRECURSOR, VGAM2 PRECURSOR, VGAM3 PRECURSOR, VGAM4 PRECURSOR, VGAM5 PRECURSOR, VGAM6 PRECURSOR, VGAM7 PRECURSOR and VGAM8 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM58 RNA, VGAM59 RNA, VGAM60 RNA, VGAM61 RNA, VGAM62 RNA, VGAM63 RNA, VGAM64 RNA and VGAM65 RNA respectively, herein schematically represented by VGAM1 RNA, VGAM2 RNA, VGAM3 RNA, VGAM4 RNA, VGAM5 RNA, VGAM6 RNA, VGAM7 RNA and VGAM8 RNA respectively, each of which VGAM RNAs corresponding to VGAM RNA of FIG. 8.

VGAM58 RNA, herein schematically represented by VGAM1 binds complimentarily to a host target binding site located in an untranslated region of VGAM58 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM58 host target RNA, herein schematically represented by VGAM1 HOST TARGET RNA into VGAM58 host target protein, herein schematically represented by VGAM1 HOST TARGET PROTEIN, both of FIG. 1.

VGAM59 RNA, herein schematically represented by VGAM2 binds complimentarily to a host target binding site located in an untranslated region of VGAM59 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM59 host target RNA, herein schematically represented by VGAM2 HOST TARGET RNA into VGAM59 host target protein, herein schematically represented by VGAM2 HOST TARGET PROTEIN, both of FIG. 1.

VGAM60 RNA, herein schematically represented by VGAM3 binds complimentarily to a host target binding site located in an untranslated region of VGAM60 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM60 host target RNA, herein schematically represented by VGAM3 HOST TARGET RNA into VGAM60 host target protein, herein schematically represented by VGAM3 HOST TARGET PROTEIN, both of FIG. 1.

VGAM61 RNA, herein schematically represented by VGAM4 binds complimentarily to a host target binding site located in an untranslated region of VGAM61 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM61 host target RNA, herein schematically represented by VGAM4 HOST TARGET RNA into VGAM61 host target protein, herein schematically represented by VGAM4 HOST TARGET PROTEIN, both of FIG. 1.

VGAM62 RNA, herein schematically represented by VGAM5 binds complimentarily to a host target binding site located in an untranslated region of VGAM62 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM62 host target RNA, herein schematically represented by VGAM5 HOST TARGET RNA into VGAM62 host target protein, herein schematically represented by VGAM5 HOST TARGET PROTEIN, both of FIG. 1.

VGAM63 RNA, herein schematically represented by VGAM6 binds complimentarily to a host target binding site located in an untranslated region of VGAM63 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM63 host target RNA, herein schematically represented by VGAM6 HOST TARGET RNA into VGAM63 host target protein, herein schematically represented by VGAM6 HOST TARGET PROTEIN, both of FIG. 1.

VGAM64 RNA, herein schematically represented by VGAM7 binds complimentarily to a host target binding site located in an untranslated region of VGAM64 host target RNA, herein schematically represented by VGAM7 HOST TARGET RNA, which host target binding site corresponds to a host target binding site such as BINDING SITE I, BINDING SITE II or BINDING SITE III of FIG. 1, thereby inhibiting translation of VGAM64 host target RNA, herein schematically represented by VGAM7 HOST TARGET RNA into VGAM64 host target protein, herein schematically represented by VGAM7 HOST TARGET PROTEIN, both of FIG. 1.

VGAM65 RNA, herein schematically represented by VGAM8 binds complimentarily to a host target binding site located in an untranslated region of VGAM65 host target RNA, herein schematically represented by VGAM8 HOST TARGET RNA, which host target binding site corresponds to a host target binding site such as BINDING SITE I, BINDING SITE II or BINDING SITE III of FIG. 1, thereby inhibiting translation of VGAM65 host target RNA, herein schematically represented by VGAM8 HOST TARGET RNA into VGAM65 host target protein, herein schematically represented by VGAM8 HOST TARGET PROTEIN, both of FIG. 1.

It is appreciated that a function of VGR371 gene, herein designated VGR GENE, is inhibition of expression of host target genes, as part of a novel viral mechanism of attacking a host. Accordingly, utilities of VGR371 gene include diagnosis, prevention and treatment of viral infection by. Specific functions, and accordingly utilities, of VGR371 gene, herein designated VGR GENE, correlate with, and may be deduced from, the identity of the host target genes, which are inhibited by VGAM RNAs comprised in the operon-like cluster of VGR371 gene: VGAM58 host target protein, VGAM59 host target protein, VGAM60 host target protein, VGAM61 host target protein, VGAM62 host target protein, VGAM63 host target protein, VGAM64 host target protein and VGAM65 host target protein, herein schematically represented by VGAM1 HOST TARGET PROTEIN through VGAM HOST TARGET PROTEIN respectively. The function of these host target genes is elaborated hereinabove with reference to VGAM58, VGAM59, VGAM60, VGAM61, VGAM62, VGAM63, VGAM64 and VGAM65

FIG. 9 further provides a conceptual description of novel bioinformatically detected regulatory viral gene, referred to here as Viral Genomic Record 372(VGR372) viral gene, which encodes an operon-like cluster of novel viral micro RNA-like genes, each of which in turn modulates expression of at least one host target gene, the function and utility of which at least one host target gene is known in the art.

VGR372 gene, herein designated VGR GENE, is a novel bioinformatically detected regulatory, non protein coding, RNA viral gene. The method by which VGR372 gene was detected is described hereinabove with reference to FIGS. 6-15.

VGR372 gene encodes VGR372 precursor RNA, herein designated VGR PRECURSOR RNA, an RNA molecule, typically several hundred nucleotides long.

VGR372 precursor RNA folds spatially, forming VGR372 folded precursor RNA, herein designated VGR FOLDED PRECURSOR RNA. It is appreciated that VGR372 folded precursor RNA, herein designated VGR FOLDED PRECURSOR RNA, comprises a plurality of what is known in the art as hairpin structures. These hairpin structures are due to the fact that the nucleotide sequence of VGR372 precursor RNA comprises a plurality of segments, the first half of each such segment having a nucleotide sequence which is at least a partial inversed-reversed sequence of the second half thereof, as is well known in the art.

VGR372 folded precursor RNA, herein designated VGR FOLDED PRECURSOR RNA, is naturally processed by cellular enzymatic activity into at least 3 separate VGAM precursor RNAs, VGAM66 precursor RNA, VGAM67 precursor RNA and VGAM68 precursor RNA, herein schematically represented by VGAM1 PRECURSOR, VGAM2 PRECURSOR and VGAM3 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM66 RNA, VGAM67 RNA and VGAM68 RNA respectively, herein schematically represented by VGAM1 RNA, VGAM2 RNA and VGAM3 RNA respectively, each of which VGAM RNAs corresponding to VGAM RNA of FIG. 8.

VGAM66 RNA, herein schematically represented by VGAM1 binds complimentarily to a host target binding site located in an untranslated region of VGAM66 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM66 host target RNA, herein schematically represented by VGAM1 HOST TARGET RNA into VGAM66 host target protein, herein schematically represented by VGAM1 HOST TARGET PROTEIN, both of FIG. 1.

VGAM67 RNA, herein schematically represented by VGAM2 binds complimentarily to a host target binding site located in an untranslated region of VGAM67 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM67 host target RNA, herein schematically represented by VGAM2 HOST TARGET RNA into VGAM67 host target protein, herein schematically represented by VGAM2 HOST TARGET PROTEIN, both of FIG. 1.

VGAM68 RNA, herein schematically represented by VGAM3 binds complimentarily to a host target binding site located in an untranslated region of VGAM68 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM68 host target RNA, herein schematically represented by VGAM3 HOST TARGET RNA into VGAM68 host target protein, herein schematically represented by VGAM3 HOST TARGET PROTEIN, both of FIG. 1.

It is appreciated that a function of VGR372 gene, herein designated VGR GENE, is inhibition of expression of host target genes, as part of a novel viral mechanism of attacking a host. Accordingly, utilities of VGR372 gene include diagnosis, prevention and treatment of viral infection by. Specific functions, and accordingly utilities, of VGR372 gene, herein designated VGR GENE, correlate with, and may be deduced from, the identity of the host target genes, which are inhibited by VGAM RNAs comprised in the operon-like cluster of VGR372 gene: VGAM66 host target protein, VGAM67 host target protein and VGAM68 host target protein, herein schematically represented by VGAM1 HOST TARGET PROTEIN through VGAM HOST TARGET PROTEIN respectively. The function of these host target genes is elaborated hereinabove with reference to VGAM66, VGAM67 and VGAM68

FIG. 9 further provides a conceptual description of novel bioinformatically detected regulatory viral gene, referred to here as Viral Genomic Record 373(VGR373) viral gene, which encodes an operon-like cluster of novel viral micro RNA-like genes, each of which in turn modulates expression of at least one host target gene, the function and utility of which at least one host target gene is known in the art.

VGR373 gene, herein designated VGR GENE, is a novel bioinformatically detected regulatory, non protein coding, RNA viral gene. The method by which VGR373 gene was detected is described hereinabove with reference to FIGS. 6-15.

VGR373 gene encodes VGR373 precursor RNA, herein designated VGR PRECURSOR RNA, an RNA molecule, typically several hundred nucleotides long.

VGR373 precursor RNA folds spatially, forming VGR373 folded precursor RNA, herein designated VGR FOLDED PRECURSOR RNA. It is appreciated that VGR373 folded precursor RNA, herein designated VGR FOLDED PRECURSOR RNA, comprises a plurality of what is known in the art as hairpin structures. These hairpin structures are due to the fact that the nucleotide sequence of VGR373 precursor RNA comprises a plurality of segments, the first half of each such segment having a nucleotide sequence which is at least a partial inversed-reversed sequence of the second half thereof, as is well known in the art.

VGR373 folded precursor RNA, herein designated VGR FOLDED PRECURSOR RNA, is naturally processed by cellular enzymatic activity into at least 3 separate VGAM precursor RNAs, VGAM71 precursor RNA, VGAM72 precursor RNA and VGAM73 precursor RNA, herein schematically represented by VGAM1 PRECURSOR, VGAM2 PRECURSOR and VGAM3 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM71 RNA, VGAM72 RNA and VGAM73 RNA respectively, herein schematically represented by VGAM1 RNA, VGAM2 RNA and VGAM3 RNA respectively, each of which VGAM RNAs corresponding to VGAM RNA of FIG. 8.

VGAM71 RNA, herein schematically represented by VGAM1 binds complimentarily to a host target binding site located in an untranslated region of VGAM71 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM71 host target RNA, herein schematically represented by VGAM1 HOST TARGET RNA into VGAM71 host target protein, herein schematically represented by VGAM1 HOST TARGET PROTEIN, both of FIG. 1.

VGAM72 RNA, herein schematically represented by VGAM2 binds complimentarily to a host target binding site located in an untranslated region of VGAM72 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM72 host target RNA, herein schematically represented by VGAM2 HOST TARGET RNA into VGAM72 host target protein, herein schematically represented by VGAM2 HOST TARGET PROTEIN, both of FIG. 1.

VGAM73 RNA, herein schematically represented by VGAM3 binds complimentarily to a host target binding site located in an untranslated region of VGAM73 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM73 host target RNA, herein schematically represented by VGAM3 HOST TARGET RNA into VGAM73 host target protein, herein schematically represented by VGAM3 HOST TARGET PROTEIN, both of FIG. 1.

It is appreciated that a function of VGR373 gene, herein designated VGR GENE, is inhibition of expression of host target genes, as part of a novel viral mechanism of attacking a host. Accordingly, utilities of VGR373 gene include diagnosis, prevention and treatment of viral infection by. Specific functions, and accordingly utilities, of VGR373 gene, herein designated VGR GENE, correlate with, and may be deduced from, the identity of the host target genes, which are inhibited by VGAM RNAs comprised in the operon-like cluster of VGR373 gene: VGAM71 host target protein, VGAM72 host target protein and VGAM73 host target protein, herein schematically represented by VGAM1 HOST TARGET PROTEIN through VGAM HOST TARGET PROTEIN respectively. The function of these host target genes is elaborated hereinabove with reference to VGAM71, VGAM72 and VGAM73

FIG. 9 further provides a conceptual description of novel bioinformatically detected regulatory viral gene, referred to here as Viral Genomic Record 374(VGR374) viral gene, which encodes an operon-like cluster of novel viral micro RNA-like genes, each of which in turn modulates expression of at least one host target gene, the function and utility of which at least one host target gene is known in the art.

VGR374 gene, herein designated VGR GENE, is a novel bioinformatically detected regulatory, non protein coding, RNA viral gene. The method by which VGR374 gene was detected is described hereinabove with reference to FIGS. 6-15.

VGR374 gene encodes VGR374 precursor RNA, herein designated VGR PRECURSOR RNA, an RNA molecule, typically several hundred nucleotides long.

VGR374 precursor RNA folds spatially, forming VGR374 folded precursor RNA, herein designated VGR FOLDED PRECURSOR RNA. It is appreciated that VGR374 folded precursor RNA, herein designated VGR FOLDED PRECURSOR RNA, comprises a plurality of what is known in the art as hairpin structures. These hairpin structures are due to the fact that the nucleotide sequence of VGR374 precursor RNA comprises a plurality of segments, the first half of each such segment having a nucleotide sequence which is at least a partial inversed-reversed sequence of the second half thereof, as is well known in the art.

VGR374 folded precursor RNA, herein designated VGR FOLDED PRECURSOR RNA, is naturally processed by cellular enzymatic activity into at least 2 separate VGAM precursor RNAs, VGAM74 precursor RNA and VGAM75 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM74 RNA and VGAM75 RNA respectively, herein schematically represented by VGAM1 RNA and VGAM2 RNA respectively, each of which VGAM RNAs corresponding to VGAM RNA of FIG. 8.

VGAM74 RNA, herein schematically represented by VGAM1 binds complimentarily to a host target binding site located in an untranslated region of VGAM74 host target RNA, herein schematically represented by VGAM1 HOST TARGET RNA, which host target binding site corresponds to a host target binding site such as BINDING SITE I, BIND- ING SITE II or BINDING SITE III of FIG. 1, thereby inhibiting translation of VGAM74 host target RNA, herein schematically represented by VGAM1 HOST TARGET RNA into VGAM74 host target protein, herein schematically represented by VGAM1 HOST TARGET PROTEIN, both of FIG. 1.

VGAM75 RNA, herein schematically represented by VGAM2 binds complimentarily to a host target binding site located in an untranslated region of VGAM75 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM75 host target RNA, herein schematically represented by VGAM2 HOST TARGET RNA into VGAM75 host target protein, herein schematically represented by VGAM2 HOST TARGET PROTEIN, both of FIG. 1.

It is appreciated that a function of VGR374 gene, herein designated VGR GENE, is inhibition of expression of host target genes, as part of a novel viral mechanism of attacking a host. Accordingly, utilities of VGR374 gene include diagnosis, prevention and treatment of viral infection by. Specific functions, and accordingly utilities, of VGR374 gene, herein designated VGR GENE, correlate with, and may be deduced from, the identity of the host target genes, which are inhibited by VGAM RNAs comprised in the operon-like cluster of VGR374 gene: VGAM74 host target protein and VGAM75 host target protein, herein schematically represented by VGAM1 HOST TARGET PROTEIN and VGAM HOST TARGET PROTEIN respectively. The function of these host target genes is elaborated hereinabove with reference to VGAM74 and VGAM75

FIG. 9 further provides a conceptual description of novel bioinformatically detected regulatory viral gene, referred to here as Viral Genomic Record 375(VGR375) viral gene, which encodes an operon-like cluster of novel viral micro RNA-like genes, each of which in turn modulates expression of at least one host target gene, the function and utility of which at least one host target gene is known in the art.

VGR375 gene, herein designated VGR GENE, is a novel bioinformatically detected regulatory, non protein coding, RNA viral gene. The method by which VGR375 gene was detected is described hereinabove with reference to FIGS. 6-15.

VGR375 gene encodes VGR375 precursor RNA, herein designated VGR PRECURSOR RNA, an RNA molecule, typically several hundred nucleotides long.

VGR375 precursor RNA folds spatially, forming VGR375 folded precursor RNA, herein designated VGR FOLDED PRECURSOR RNA. It is appreciated that VGR375 folded precursor RNA, herein designated VGR FOLDED PRECURSOR RNA, comprises a plurality of what is known in the art as hairpin structures. These hairpin structures are due to the fact that the nucleotide sequence of VGR375 precursor RNA comprises a plurality of segments, the first half of each such segment having a nucleotide sequence which is at least a partial inversed-reversed sequence of the second half thereof, as is well known in the art.

VGR375 folded precursor RNA, herein designated VGR FOLDED PRECURSOR RNA, is naturally processed by cellular enzymatic activity into at least 3 separate VGAM precursor RNAs, VGAM77 precursor RNA, VGAM78 precursor RNA and VGAM79 precursor RNA, herein schematically represented by VGAM1 PRECURSOR, VGAM2 PRECURSOR and VGAM3 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM77 RNA, VGAM78 RNA and VGAM79 RNA respectively, herein schematically represented by VGAM1 RNA, VGAM2 RNA and VGAM3 RNA respectively, each of which VGAM RNAs corresponding to VGAM RNA of FIG. 8.

VGAM77 RNA, herein schematically represented by VGAM1 binds complimentarily to a host target binding site located in an untranslated region of VGAM77 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM77 host target RNA, herein schematically represented by VGAM1 HOST TARGET RNA into VGAM77 host target protein, herein schematically represented by VGAM1 HOST TARGET PROTEIN, both of FIG. 1.

VGAM78 RNA, herein schematically represented by VGAM2 binds complimentarily to a host target binding site located in an untranslated region of VGAM78 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM78 host target RNA, herein schematically represented by VGAM2 HOST TARGET RNA into VGAM78 host target protein, herein schematically represented by VGAM2 HOST TARGET PROTEIN, both of FIG. 1.

VGAM79 RNA, herein schematically represented by VGAM3 binds complimentarily to a host target binding site located in an untranslated region of VGAM79 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM79 host target RNA, herein schematically represented by VGAM3 HOST TARGET RNA into VGAM79 host target protein, herein schematically represented by VGAM3 HOST TARGET PROTEIN, both of FIG. 1.

It is appreciated that a function of VGR375 gene, herein designated VGR GENE, is inhibition of expression of host target genes, as part of a novel viral mechanism of attacking a host. Accordingly, utilities of VGR375 gene include diagnosis, prevention and treatment of viral infection by. Specific functions, and accordingly utilities, of VGR375 gene, herein designated VGR GENE, correlate with, and may be deduced from, the identity of the host target genes, which are inhibited by VGAM RNAs comprised in the operon-like cluster of VGR375 gene: VGAM77 host target protein, VGAM78 host target protein and VGAM79 host target protein, herein schematically represented by VGAM1 HOST TARGET PROTEIN through VGAM HOST TARGET PROTEIN respectively. The function of these host target genes is elaborated hereinabove with reference to VGAM77, VGAM78 and VGAM79

FIG. 9 further provides a conceptual description of novel bioinformatically detected regulatory viral gene, referred to here as Viral Genomic Record 376(VGR376) viral gene, which encodes an operon-like cluster of novel viral micro RNA-like genes, each of which in turn modulates expression of at least one host target gene, the function and utility of which at least one host target gene is known in the art.

VGR376 gene, herein designated VGR GENE, is a novel bioinformatically detected regulatory, non protein coding, RNA viral gene. The method by which VGR376 gene was detected is described hereinabove with reference to FIGS. 6-15.

VGR376 gene encodes VGR376 precursor RNA, herein designated VGR PRECURSOR RNA, an RNA molecule, typically several hundred nucleotides long.

VGR376 precursor RNA folds spatially, forming VGR376 folded precursor RNA, herein designated VGR FOLDED PRECURSOR RNA. It is appreciated that VGR376 folded precursor RNA, herein designated VGR FOLDED PRECURSOR RNA, comprises a plurality of what is known in the art as hairpin structures. These hairpin structures are due to the fact that the nucleotide sequence of VGR376 precursor RNA comprises a plurality of segments, the first half of each such segment having a nucleotide sequence which is at least a partial inversed-reversed sequence of the second half thereof, as is well known in the art.

VGR376 folded precursor RNA, herein designated VGR FOLDED PRECURSOR RNA, is naturally processed by cellular enzymatic activity into at least 8 separate VGAM precursor RNAs, VGAM81 precursor RNA, VGAM82 precursor RNA, VGAM83 precursor RNA, VGAM84 precursor RNA, VGAM85 precursor RNA, VGAM86 precursor RNA, VGAM87 precursor RNA and VGAM88 precursor RNA, herein schematically represented by VGAM1 PRECURSOR, VGAM2 PRECURSOR, VGAM3 PRECURSOR, VGAM4 PRECURSOR, VGAM5 PRECURSOR, VGAM6 PRECURSOR, VGAM7 PRECURSOR and VGAM8 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM81 RNA, VGAM82 RNA, VGAM83 RNA, VGAM84 RNA, VGAM85 RNA, VGAM86 RNA, VGAM87 RNA and VGAM88 RNA respectively, herein schematically represented by VGAM1 RNA, VGAM2 RNA, VGAM3 RNA, VGAM4 RNA, VGAM5 RNA, VGAM6 RNA, VGAM7 RNA and VGAM8 RNA respectively, each of which VGAM RNAs corresponding to VGAM RNA of FIG. 8.

VGAM81 RNA, herein schematically represented by VGAM1 binds complimentarily to a host target binding site located in an untranslated region of VGAM81 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM81 host target RNA, herein schematically represented by VGAM1 HOST TARGET RNA into VGAM81 host target protein, herein schematically represented by VGAM1 HOST TARGET PROTEIN, both of FIG. 1.

VGAM82 RNA, herein schematically represented by VGAM2 binds complimentarily to a host target binding site located in an untranslated region of VGAM82 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM82 host target RNA, herein schematically represented by VGAM2 HOST TARGET RNA into VGAM82 host target protein, herein schematically represented by VGAM2 HOST TARGET PROTEIN, both of FIG. 1.

VGAM83 RNA, herein schematically represented by VGAM3 binds complimentarily to a host target binding site located in an untranslated region of VGAM83 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM83 host target RNA, herein schematically represented by VGAM3 HOST TARGET RNA into VGAM83 host target protein, herein schematically represented by VGAM3 HOST TARGET PROTEIN, both of FIG. 1.

VGAM84 RNA, herein schematically represented by VGAM4 binds complimentarily to a host target binding site located in an untranslated region of VGAM84 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM84 host target RNA, herein schematically represented by VGAM4 HOST TARGET RNA into VGAM84 host target protein, herein schematically represented by VGAM4 HOST TARGET PROTEIN, both of FIG. 1.

VGAM85 RNA, herein schematically represented by VGAM5 binds complimentarily to a host target binding site located in an untranslated region of VGAM85 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM85 host target RNA, herein schematically represented by VGAM5 HOST TARGET RNA into VGAM85 host target protein, herein schematically represented by VGAM5 HOST TARGET PROTEIN, both of FIG. 1.

VGAM86 RNA, herein schematically represented by VGAM6 binds complimentarily to a host target binding site located in an untranslated region of VGAM86 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM86 host target RNA, herein schematically represented by VGAM6 HOST TARGET RNA into VGAM86 host target protein, herein schematically represented by VGAM6 HOST TARGET PROTEIN, both of FIG. 1.

VGAM87 RNA, herein schematically represented by VGAM7 binds complimentarily to a host target binding site located in an untranslated region of VGAM87 host target RNA, herein schematically represented by VGAM7 HOST TARGET RNA, which host target binding site corresponds to a host target binding site such as BINDING SITE I, BINDING SITE II or BINDING SITE III of FIG. 1, thereby inhibiting translation of VGAM87 host target RNA, herein schematically represented by VGAM7 HOST TARGET RNA into VGAM87 host target protein, herein schematically represented by VGAM7 HOST TARGET PROTEIN, both of FIG. 1.

VGAM88 RNA, herein schematically represented by VGAM8 binds complimentarily to a host target binding site located in an untranslated region of VGAM88 host target RNA, herein schematically represented by VGAM8 HOST TARGET RNA, which host target binding site corresponds to a host target binding site such as BINDING SITE I, BINDING SITE II or BINDING SITE III of FIG. 1, thereby inhibiting translation of VGAM88 host target RNA, herein schematically represented by VGAM8 HOST TARGET RNA into VGAM88 host target protein, herein schematically represented by VGAM8 HOST TARGET PROTEIN, both of FIG. 1.

It is appreciated that a function of VGR376 gene, herein designated VGR GENE, is inhibition of expression of host target genes, as part of a novel viral mechanism of attacking a host. Accordingly, utilities of VGR376 gene include diagnosis, prevention and treatment of viral infection by. Specific functions, and accordingly utilities, of VGR376 gene, herein designated VGR GENE, correlate with, and may be deduced from, the identity of the host target genes, which are inhibited by VGAM RNAs comprised in the operon-like cluster of VGR376 gene: VGAM81 host target protein, VGAM82 host target protein, VGAM83 host target protein, VGAM84 host target protein, VGAM85 host target protein, VGAM86 host target protein, VGAM87 host target protein and VGAM88 host target protein, herein schematically represented by VGAM1 HOST TARGET PROTEIN through VGAM HOST TARGET PROTEIN respectively. The function of these host target genes is elaborated hereinabove with reference to VGAM81, VGAM82, VGAM83, VGAM84, VGAM85, VGAM86, VGAM87 and VGAM88

FIG. 9 further provides a conceptual description of novel bioinformatically detected regulatory viral gene, referred to here as Viral Genomic Record 377(VGR377) viral gene, which encodes an operon-like cluster of novel viral micro RNA-like genes, each of which in turn modulates expression of at least one host target gene, the function and utility of which at least one host target gene is known in the art.

VGR377 gene, herein designated VGR GENE, is a novel bioinformatically detected regulatory, non protein coding, RNA viral gene. The method by which VGR377 gene was detected is described hereinabove with reference to FIGS. 6-15.

VGR377 gene encodes VGR377 precursor RNA, herein designated VGR PRECURSOR RNA, an RNA molecule, typically several hundred nucleotides long.

VGR377 precursor RNA folds spatially, forming VGR377 folded precursor RNA, herein designated VGR FOLDED PRECURSOR RNA. It is appreciated that VGR377 folded precursor RNA, herein designated VGR FOLDED PRECURSOR RNA, comprises a plurality of what is known in the art as hairpin structures. These hairpin structures are due to the fact that the nucleotide sequence of VGR377 precursor RNA comprises a plurality of segments, the first half of each such segment having a nucleotide sequence which is at least a partial inversed-reversed sequence of the second half thereof, as is well known in the art.

VGR377 folded precursor RNA, herein designated VGR FOLDED PRECURSOR RNA, is naturally processed by cellular enzymatic activity into at least 7 separate VGAM precursor RNAs, VGAM91 precursor RNA, VGAM92 precursor RNA, VGAM93 precursor RNA, VGAM94 precursor RNA, VGAM95 precursor RNA, VGAM96 precursor RNA and VGAM97 precursor RNA, herein schematically represented by VGAM1 PRECURSOR, VGAM2 PRECURSOR, VGAM3 PRECURSOR, VGAM4 PRECURSOR, VGAM5 PRECURSOR, VGAM6 PRECURSOR and VGAM7 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM91 RNA, VGAM92 RNA, VGAM93 RNA, VGAM94 RNA, VGAM95 RNA, VGAM96 RNA and VGAM97 RNA respectively, herein schematically represented by VGAM1 RNA, VGAM2 RNA, VGAM3 RNA, VGAM4 RNA, VGAM5 RNA, VGAM6 RNA and VGAM7 RNA respectively, each of which VGAM RNAs corresponding to VGAM RNA of FIG. 8.

VGAM91 RNA, herein schematically represented by VGAM1 binds complimentarily to a host target binding site located in an untranslated region of VGAM91 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM91 host target RNA, herein schematically represented by VGAM1 HOST TARGET RNA into VGAM91 host target protein, herein schematically represented by VGAM1 HOST TARGET PROTEIN, both of FIG. 1.

VGAM92 RNA, herein schematically represented by VGAM2 binds complimentarily to a host target binding site located in an untranslated region of VGAM92 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM92 host target RNA, herein schematically represented by VGAM2 HOST TARGET RNA into VGAM92 host target protein, herein schematically represented by VGAM2 HOST TARGET PROTEIN, both of FIG. 1.

VGAM93 RNA, herein schematically represented by VGAM3 binds complimentarily to a host target binding site located in an untranslated region of VGAM93 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM93 host target RNA, herein schematically represented by VGAM3 HOST TARGET RNA into VGAM93 host target protein, herein schematically represented by VGAM3 HOST TARGET PROTEIN, both of FIG. 1.

VGAM94 RNA, herein schematically represented by VGAM4 binds complimentarily to a host target binding site located in an untranslated region of VGAM94 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM94 host target RNA, herein schematically represented by VGAM4 HOST TARGET RNA into VGAM94 host target protein, herein schematically represented by VGAM4 HOST TARGET PROTEIN, both of FIG. 1.

VGAM95 RNA, herein schematically represented by VGAM5 binds complimentarily to a host target binding site located in an untranslated region of VGAM95 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM95 host target RNA, herein schematically represented by VGAM5 HOST TARGET RNA into VGAM95 host target protein, herein schematically represented by VGAM5 HOST TARGET PROTEIN, both of FIG. 1.

VGAM96 RNA, herein schematically represented by VGAM6 binds complimentarily to a host target binding site located in an untranslated region of VGAM96 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM96 host target RNA, herein schematically represented by VGAM6 HOST TARGET RNA into VGAM96 host target protein, herein schematically represented by VGAM6 HOST TARGET PROTEIN, both of FIG. 1.

VGAM97 RNA, herein schematically represented by VGAM7 binds complimentarily to a host target binding site located in an untranslated region of VGAM97 host target RNA, herein schematically represented by VGAM7 HOST TARGET RNA, which host target binding site corresponds to a host target binding site such as BINDING SITE I, BINDING SITE II or BINDING SITE III of FIG. 1, thereby inhibiting translation of VGAM97 host target RNA, herein schematically represented by VGAM7 HOST TARGET RNA into VGAM97 host target protein, herein schematically represented by VGAM7 HOST TARGET PROTEIN, both of FIG. 1.

It is appreciated that a function of VGR377 gene, herein designated VGR GENE, is inhibition of expression of host target genes, as part of a novel viral mechanism of attacking a host. Accordingly, utilities of VGR377 gene include diagnosis, prevention and treatment of viral infection by. Specific functions, and accordingly utilities, of VGR377 gene, herein designated VGR GENE, correlate with, and may be deduced from, the identity of the host target genes, which are inhibited by VGAM RNAs comprised in the operon-like cluster of VGR377 gene: VGAM91 host target protein, VGAM92 host target protein, VGAM93 host target protein, VGAM94 host target protein, VGAM95 host target protein, VGAM96 host target protein and VGAM97 host target protein, herein schematically represented by VGAM1 HOST TARGET PROTEIN through VGAM HOST TARGET PROTEIN respectively. The function of these host target genes is elaborated hereinabove with reference to VGAM91, VGAM92, VGAM93, VGAM94, VGAM95, VGAM96 and VGAM97

FIG. 9 further provides a conceptual description of novel bioinformatically detected regulatory viral gene, referred to here as Viral Genomic Record 378(VGR378) viral gene, which encodes an operon-like cluster of novel viral micro RNA-like genes, each of which in turn modulates expression of at least one host target gene, the function and utility of which at least one host target gene is known in the art.

VGR378 gene, herein designated VGR GENE, is a novel bioinformatically detected regulatory, non protein coding, RNA viral gene. The method by which VGR378 gene was detected is described hereinabove with reference to FIGS. 6-15.

VGR378 gene encodes VGR378 precursor RNA, herein designated VGR PRECURSOR RNA, an RNA molecule, typically several hundred nucleotides long.

VGR378 precursor RNA folds spatially, forming VGR378 folded precursor RNA, herein designated VGR FOLDED PRECURSOR RNA. It is appreciated that VGR378 folded precursor RNA, herein designated VGR FOLDED PRECURSOR RNA, comprises a plurality of what is known in the art as hairpin structures. These hairpin structures are due to the fact that the nucleotide sequence of VGR378 precursor RNA comprises a plurality of segments, the first half of each such segment having a nucleotide sequence which is at least a partial inversed-reversed sequence of the second half thereof, as is well known in the art.

VGR378 folded precursor RNA, herein designated VGR FOLDED PRECURSOR RNA, is naturally processed by cellular enzymatic activity into at least 2 separate VGAM precursor RNAs, VGAM99 precursor RNA and VGAM100 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM99 RNA and VGAM100 RNA respectively, herein schematically represented by VGAM1 RNA and VGAM2 RNA respectively, each of which VGAM RNAs corresponding to VGAM RNA of FIG. 8.

VGAM99 RNA, herein schematically represented by VGAM1 binds complimentarily to a host target binding site located in an untranslated region of VGAM99 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM99 host target RNA, herein schematically represented by VGAM1 HOST TARGET RNA into VGAM99 host target protein, herein schematically represented by VGAM1 HOST TARGET PROTEIN, both of FIG. 1.

VGAM100 RNA, herein schematically represented by VGAM2 binds complimentarily to a host target binding site located in an untranslated region of VGAM100 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM100 host target RNA, herein schematically represented by VGAM2 HOST TARGET RNA into VGAM100 host target protein, herein schematically represented by VGAM2 HOST TARGET PROTEIN, both of FIG. 1.

It is appreciated that a function of VGR378 gene, herein designated VGR GENE, is inhibition of expression of host target genes, as part of a novel viral mechanism of attacking a host. Accordingly, utilities of VGR378 gene include diagnosis, prevention and treatment of viral infection by. Specific functions, and accordingly utilities, of VGR378 gene, herein designated VGR GENE, correlate with, and may be deduced from, the identity of the host target genes, which are inhibited by VGAM RNAs comprised in the operon-like cluster of VGR378 gene: VGAM99 host target protein and VGAM100 host target protein, herein schematically represented by VGAM1 HOST TARGET PROTEIN and VGAM HOST TARGET PROTEIN respectively. The function of these host target genes is elaborated hereinabove with reference to VGAM99 and VGAM100

FIG. 9 further provides a conceptual description of novel bioinformatically detected regulatory viral gene, referred to here as Viral Genomic Record 379(VGR379) viral gene, which encodes an operon-like cluster of novel viral micro RNA-like genes, each of which in turn modulates expression of at least one host target gene, the function and utility of which at least one host target gene is known in the art.

VGR379 gene, herein designated VGR GENE, is a novel bioinformatically detected regulatory, non protein coding, RNA viral gene. The method by which VGR379 gene was detected is described hereinabove with reference to FIGS. 6-15.

VGR379 gene encodes VGR379 precursor RNA, herein designated VGR PRECURSOR RNA, an RNA molecule, typically several hundred nucleotides long.

VGR379 precursor RNA folds spatially, forming VGR379 folded precursor RNA, herein designated VGR FOLDED PRECURSOR RNA. It is appreciated that VGR379 folded precursor RNA, herein designated VGR FOLDED PRECURSOR RNA, comprises a plurality of what is known in the art as hairpin structures. These hairpin structures are due to the fact that the nucleotide sequence of VGR379 precursor RNA comprises a plurality of segments, the first half of each such segment having a nucleotide sequence which is at least a partial inversed-reversed sequence of the second half thereof, as is well known in the art.

VGR379 folded precursor RNA, herein designated VGR FOLDED PRECURSOR RNA, is naturally processed by cellular enzymatic activity into at least 3 separate VGAM precursor RNAs, VGAM101 precursor RNA, VGAM102 precursor RNA and VGAM103 precursor RNA, herein schematically represented by VGAM1 PRECURSOR, VGAM2 PRECURSOR and VGAM3 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM101 RNA, VGAM102 RNA and VGAM103 RNA respectively, herein schematically represented by VGAM1 RNA, VGAM2 RNA and VGAM3 RNA respectively, each of which VGAM RNAs corresponding to VGAM RNA of FIG. 8.

VGAM101 RNA, herein schematically represented by VGAM1 binds complimentarily to a host target binding site located in an untranslated region of VGAM101 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM101 host target RNA, herein schematically represented by VGAM1 HOST TARGET RNA into VGAM101 host target protein, herein schematically represented by VGAM1 HOST TARGET PROTEIN, both of FIG. 1.

VGAM102 RNA, herein schematically represented by VGAM2 binds complimentarily to a host target binding site located in an untranslated region of VGAM102 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM102 host target RNA, herein schematically represented by VGAM2 HOST TARGET RNA into VGAM102 host target protein, herein schematically represented by VGAM2 HOST TARGET PROTEIN, both of FIG. 1.

VGAM103 RNA, herein schematically represented by VGAM3 binds complimentarily to a host target binding site located in an untranslated region of VGAM103 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM103 host target RNA, herein schematically represented by VGAM3 HOST TARGET RNA into VGAM103 host target protein, herein schematically represented by VGAM3 HOST TARGET PROTEIN, both of FIG. 1.

It is appreciated that a function of VGR379 gene, herein designated VGR GENE, is inhibition of expression of host target genes, as part of a novel viral mechanism of attacking a host. Accordingly, utilities of VGR379 gene include diagnosis, prevention and treatment of viral infection by. Specific functions, and accordingly utilities, of VGR379 gene, herein designated VGR GENE, correlate with, and may be deduced from, the identity of the host target genes, which are inhibited by VGAM RNAs comprised in the operon-like cluster of VGR379 gene: VGAM101 host target protein, VGAM102 host target protein and VGAM103 host target protein, herein schematically represented by VGAM1 HOST TARGET PROTEIN through VGAM HOST TARGET PROTEIN respectively. The function of these host target genes is elaborated hereinabove with reference to VGAM101, VGAM102 and VGAM103

FIG. 9 further provides a conceptual description of novel bioinformatically detected regulatory viral gene, referred to here as Viral Genomic Record 380(VGR380) viral gene, which encodes an operon-like cluster of novel viral micro RNA-like genes, each of which in turn modulates expression of at least one host target gene, the function and utility of which at least one host target gene is known in the art.

VGR380 gene, herein designated VGR GENE, is a novel bioinformatically detected regulatory, non protein coding, RNA viral gene. The method by which VGR380 gene was detected is described hereinabove with reference to FIGS. 6-15.

VGR380 gene encodes VGR380 precursor RNA, herein designated VGR PRECURSOR RNA, an RNA molecule, typically several hundred nucleotides long.

VGR380 precursor RNA folds spatially, forming VGR380 folded precursor RNA, herein designated VGR FOLDED PRECURSOR RNA. It is appreciated that VGR380 folded precursor RNA, herein designated VGR FOLDED PRECURSOR RNA, comprises a plurality of what is known in the art as hairpin structures. These hairpin structures are due to the fact that the nucleotide sequence of VGR380 precursor RNA comprises a plurality of segments, the first half of each such segment having a nucleotide sequence which is at least a partial inversed-reversed sequence of the second half thereof, as is well known in the art.

VGR380 folded precursor RNA, herein designated VGR FOLDED PRECURSOR RNA, is naturally processed by cellular enzymatic activity into at least 5 separate VGAM precursor RNAs, VGAM104 precursor RNA, VGAM105 precursor RNA, VGAM106 precursor RNA, VGAM107 precursor RNA and VGAM108 precursor RNA, herein schematically represented by VGAM1 PRECURSOR, VGAM2 PRECURSOR, VGAM3 PRECURSOR, VGAM4 PRECURSOR and VGAM5 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM104 RNA, VGAM105 RNA, VGAM106 RNA, VGAM107 RNA and VGAM108 RNA respectively, herein schematically represented by VGAM1 RNA, VGAM2 RNA, VGAM3 RNA, VGAM4 RNA and VGAM5 RNA respectively, each of which VGAM RNAs corresponding to VGAM RNA of FIG. 8.

VGAM104 RNA, herein schematically represented by VGAM1 binds complimentarily to a host target binding site located in an untranslated region of VGAM104 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM104 host target RNA, herein schematically represented by VGAM1 HOST TARGET RNA into VGAM104 host target protein, herein schematically represented by VGAM1 HOST TARGET PROTEIN, both of FIG. 1.

VGAM105 RNA, herein schematically represented by VGAM2 binds complimentarily to a host target binding site located in an untranslated region of VGAM105 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM105 host target RNA, herein schematically represented by VGAM2 HOST TARGET RNA into VGAM105 host target protein, herein schematically represented by VGAM2 HOST TARGET PROTEIN, both of FIG. 1.

VGAM106 RNA, herein schematically represented by VGAM3 binds complimentarily to a host target binding site located in an untranslated region of VGAM106 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM106 host target RNA, herein schematically represented by VGAM3 HOST TARGET RNA into VGAM106 host target protein, herein schematically represented by VGAM3 HOST TARGET PROTEIN, both of FIG. 1.

VGAM107 RNA, herein schematically represented by VGAM4 binds complimentarily to a host target binding site located in an untranslated region of VGAM107 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM107 host target RNA, herein schematically represented by VGAM4 HOST TARGET RNA into VGAM107 host target protein, herein schematically represented by VGAM4 HOST TARGET PROTEIN, both of FIG. 1.

VGAM108 RNA, herein schematically represented by VGAM5 binds complimentarily to a host target binding site located in an untranslated region of VGAM108 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM108 host target RNA, herein schematically represented by VGAM5 HOST TARGET RNA into VGAM108 host target protein, herein schematically represented by VGAM5 HOST TARGET PROTEIN, both of FIG. 1.

It is appreciated that a function of VGR380 gene, herein designated VGR GENE, is inhibition of expression of host target genes, as part of a novel viral mechanism of attacking a host. Accordingly, utilities of VGR380 gene include diagnosis, prevention and treatment of viral infection by. Specific functions, and accordingly utilities, of VGR380 gene, herein designated VGR GENE, correlate with, and may be deduced from, the identity of the host target genes, which are inhibited by VGAM RNAs comprised in the operon-like cluster of VGR380 gene: VGAM104 host target protein, VGAM105 host target protein, VGAM106 host target protein, VGAM107 host target protein and VGAM108 host target protein, herein schematically represented by VGAM1 HOST TARGET PROTEIN through VGAM HOST TARGET PROTEIN respectively. The function of these host target genes is elaborated hereinabove with reference to VGAM104, VGAM105, VGAM106, VGAM107 and VGAM108

FIG. 9 further provides a conceptual description of novel bioinformatically detected regulatory viral gene, referred to here as Viral Genomic Record 381(VGR381) viral gene, which encodes an operon-like cluster of novel viral micro RNA-like genes, each of which in turn modulates expression of at least one host target gene, the function and utility of which at least one host target gene is known in the art.

VGR381 gene, herein designated VGR GENE, is a novel bioinformatically detected regulatory, non protein coding, RNA viral gene. The method by which VGR381 gene was detected is described hereinabove with reference to FIGS. 6-15.

VGR381 gene encodes VGR381 precursor RNA, herein designated VGR PRECURSOR RNA, an RNA molecule, typically several hundred nucleotides long.

VGR381 precursor RNA folds spatially, forming VGR381 folded precursor RNA, herein designated VGR FOLDED PRECURSOR RNA. It is appreciated that VGR381 folded precursor RNA, herein designated VGR FOLDED PRECURSOR RNA, comprises a plurality of what is known in the art as hairpin structures. These hairpin structures are due to the fact that the nucleotide sequence of VGR381 precursor RNA comprises a plurality of segments, the first half of each such segment having a nucleotide sequence which is at least a partial inversed-reversed sequence of the second half thereof, as is well known in the art.

VGR381 folded precursor RNA, herein designated VGR FOLDED PRECURSOR RNA, is naturally processed by cellular enzymatic activity into at least 8 separate VGAM precursor RNAs, VGAM110 precursor RNA, VGAM111 precursor RNA, VGAM112 precursor RNA, VGAM113 precursor RNA, VGAM114 precursor RNA, VGAM115 precursor RNA, VGAM116 precursor RNA and VGAM117 precursor RNA, herein schematically represented by VGAM1 PRECURSOR, VGAM2 PRECURSOR, VGAM3 PRECURSOR, VGAM4 PRECURSOR, VGAM5 PRECURSOR, VGAM6 PRECURSOR, VGAM7 PRECURSOR and VGAM8 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM110 RNA, VGAM111 RNA, VGAM112 RNA, VGAM113 RNA, VGAM114 RNA, VGAM115 RNA, VGAM116 RNA and VGAM117 RNA respectively, herein schematically represented by VGAM1 RNA, VGAM2 RNA, VGAM3 RNA, VGAM4 RNA, VGAM5 RNA, VGAM6 RNA, VGAM7 RNA and VGAM8 RNA respectively, each of which VGAM RNAs corresponding to VGAM RNA of FIG. 8.

VGAM110 RNA, herein schematically represented by VGAM1 binds complimentarily to a host target binding site located in an untranslated region of VGAM110 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM110 host target RNA, herein schematically represented by VGAM1 HOST TARGET RNA into VGAM110 host target protein, herein schematically represented by VGAM1 HOST TARGET PROTEIN, both of FIG. 1.

VGAM111 RNA, herein schematically represented by VGAM2 binds complimentarily to a host target binding site located in an untranslated region of VGAM111 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM111 host target RNA, herein schematically represented by VGAM2 HOST TARGET RNA into VGAM111 host target protein, herein schematically represented by VGAM2 HOST TARGET PROTEIN, both of FIG. 1.

VGAM112 RNA, herein schematically represented by VGAM3 binds complimentarily to a host target binding site located in an untranslated region of VGAM112 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM112 host target RNA, herein schematically represented by VGAM3 HOST TARGET RNA into VGAM112 host target protein, herein schematically represented by VGAM3 HOST TARGET PROTEIN, both of FIG. 1.

VGAM113 RNA, herein schematically represented by VGAM4 binds complimentarily to a host target binding site located in an untranslated region of VGAM113 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM113 host target RNA, herein schematically represented by VGAM4 HOST TARGET RNA into VGAM113 host target protein, herein schematically represented by VGAM4 HOST TARGET PROTEIN, both of FIG. 1.

VGAM114 RNA, herein schematically represented by VGAM5 binds complimentarily to a host target binding site located in an untranslated region of VGAM114 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM114 host target RNA, herein schematically represented by VGAM5 HOST TARGET RNA into VGAM114 host target protein, herein schematically represented by VGAM5 HOST TARGET PROTEIN, both of FIG. 1.

VGAM115 RNA, herein schematically represented by VGAM6 binds complimentarily to a host target binding site located in an untranslated region of VGAM115 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM115 host target RNA, herein schematically represented by VGAM6 HOST TARGET RNA into VGAM115 host target protein, herein schematically represented by VGAM6 HOST TARGET PROTEIN, both of FIG. 1.

VGAM116 RNA, herein schematically represented by VGAM7 binds complimentarily to a host target binding site located in an untranslated region of VGAM116 host target RNA, herein schematically represented by VGAM7 HOST TARGET RNA, which host target binding site corresponds to a host target binding site such as BINDING SITE I, BINDING SITE II or BINDING SITE III of FIG. 1, thereby inhibiting translation of VGAM116 host target RNA, herein schematically represented by VGAM7 HOST TARGET RNA into VGAM116 host target protein, herein schematically represented by VGAM7 HOST TARGET PROTEIN, both of FIG. 1.

VGAM117 RNA, herein schematically represented by VGAM8 binds complimentarily to a host target binding site located in an untranslated region of VGAM117 host target RNA, herein schematically represented by VGAM8 HOST TARGET RNA, which host target binding site corresponds to a host target binding site such as BINDING SITE I, BINDING SITE II or BINDING SITE III of FIG. 1, thereby inhibiting translation of VGAM117 host target RNA, herein schematically represented by VGAM8 HOST TARGET RNA into VGAM117 host target protein, herein schematically represented by VGAM8 HOST TARGET PROTEIN, both of FIG. 1.

It is appreciated that a function of VGR381 gene, herein designated VGR GENE, is inhibition of expression of host target genes, as part of a novel viral mechanism of attacking a host. Accordingly, utilities of VGR381 gene include diagnosis, prevention and treatment of viral infection by. Specific functions, and accordingly utilities, of VGR381 gene, herein designated VGR GENE, correlate with, and may be deduced from, the identity of the host target genes, which are inhibited by VGAM RNAs comprised in the operon-like cluster of VGR381 gene: VGAM110 host target protein, VGAM111 host target protein, VGAM112 host target protein, VGAM113 host target protein, VGAM114 host target protein, VGAM115 host target protein, VGAM116 host target protein and VGAM117 host target protein, herein schematically represented by VGAM1 HOST TARGET PROTEIN through VGAM HOST TARGET PROTEIN respectively. The function of these host target genes is elaborated hereinabove with reference to VGAM110, VGAM111, VGAM112, VGAM113, VGAM114, VGAM115, VGAM116 and VGAM117

FIG. 9 further provides a conceptual description of novel bioinformatically detected regulatory viral gene, referred to here as Viral Genomic Record 382(VGR382) viral gene, which encodes an operon-like cluster of novel viral micro RNA-like genes, each of which in turn modulates expression of at least one host target gene, the function and utility of which at least one host target gene is known in the art.

VGR382 gene, herein designated VGR GENE, is a novel bioinformatically detected regulatory, non protein coding, RNA viral gene. The method by which VGR382 gene was detected is described hereinabove with reference to FIGS. 6-15.

VGR382 gene encodes VGR382 precursor RNA, herein designated VGR PRECURSOR RNA, an RNA molecule, typically several hundred nucleotides long.

VGR382 precursor RNA folds spatially, forming VGR382 folded precursor RNA, herein designated VGR FOLDED PRECURSOR RNA. It is appreciated that VGR382 folded precursor RNA, herein designated VGR FOLDED PRECURSOR RNA, comprises a plurality of what is known in the art as hairpin structures. These hairpin structures are due to the fact that the nucleotide sequence of VGR382 precursor RNA comprises a plurality of segments, the first half of each such segment having a nucleotide sequence which is at least a partial inversed-reversed sequence of the second half thereof, as is well known in the art.

VGR382 folded precursor RNA, herein designated VGR FOLDED PRECURSOR RNA, is naturally processed by cellular enzymatic activity into at least 4 separate VGAM precursor RNAs, VGAM118 precursor RNA, VGAM119 precursor RNA, VGAM120 precursor RNA and VGAM121 precursor RNA, herein schematically represented by VGAM1 PRECURSOR, VGAM2 PRECURSOR, VGAM3 PRECURSOR and VGAM4 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM118 RNA, VGAM119 RNA, VGAM120 RNA and VGAM121 RNA respectively, herein schematically represented by VGAM1 RNA, VGAM2 RNA, VGAM3 RNA and VGAM4 RNA respectively, each of which VGAM RNAs corresponding to VGAM RNA of FIG. 8.

VGAM118 RNA, herein schematically represented by VGAM1 binds complimentarily to a host target binding site located in an untranslated region of VGAM118 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM118 host target RNA, herein schematically represented by VGAM1 HOST TARGET RNA into VGAM118 host target protein, herein schematically represented by VGAM1 HOST TARGET PROTEIN, both of FIG. 1.

VGAM119 RNA, herein schematically represented by VGAM2 binds complimentarily to a host target binding site located in an untranslated region of VGAM119 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM119 host target RNA, herein schematically represented by VGAM2 HOST TARGET RNA into VGAM119 host target protein, herein schematically represented by VGAM2 HOST TARGET PROTEIN, both of FIG. 1.

VGAM120 RNA, herein schematically represented by VGAM3 binds complimentarily to a host target binding site located in an untranslated region of VGAM120 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM120 host target RNA, herein schematically represented by VGAM3 HOST TARGET RNA into VGAM120 host target protein, herein schematically represented by VGAM3 HOST TARGET PROTEIN, both of FIG. 1.

VGAM121 RNA, herein schematically represented by VGAM4 binds complimentarily to a host target binding site located in an untranslated region of VGAM121 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM121 host target RNA, herein schematically represented by VGAM4 HOST TARGET RNA into VGAM121 host target protein, herein schematically represented by VGAM4 HOST TARGET PROTEIN, both of FIG. 1.

It is appreciated that a function of VGR382 gene, herein designated VGR GENE, is inhibition of expression of host target genes, as part of a novel viral mechanism of attacking a host. Accordingly, utilities of VGR382 gene include diagnosis, prevention and treatment of viral infection by. Specific functions, and accordingly utilities, of VGR382 gene, herein designated VGR GENE, correlate with, and may be deduced from, the identity of the host target genes, which are inhibited by VGAM RNAs comprised in the operon-like cluster of VGR382 gene: VGAM118 host target protein, VGAM119 host target protein, VGAM120 host target protein and VGAM121 host target protein, herein schematically represented by VGAM1 HOST TARGET PROTEIN through VGAM HOST TARGET PROTEIN respectively. The function of these host target genes is elaborated hereinabove with reference to VGAM118, VGAM119, VGAM120 and VGAM121

FIG. 9 further provides a conceptual description of novel bioinformatically detected regulatory viral gene, referred to here as Viral Genomic Record 383(VGR383) viral gene, which encodes an operon-like cluster of novel viral micro RNA-like genes, each of which in turn modulates expression of at least one host target gene, the function and utility of which at least one host target gene is known in the art.

VGR383 gene, herein designated VGR GENE, is a novel bioinformatically detected regulatory, non protein coding, RNA viral gene. The method by which VGR383 gene was detected is described hereinabove with reference to FIGS. 6-15.

VGR383 gene encodes VGR383 precursor RNA, herein designated VGR PRECURSOR RNA, an RNA molecule, typically several hundred nucleotides long.

VGR383 precursor RNA folds spatially, forming VGR383 folded precursor RNA, herein designated VGR FOLDED PRECURSOR RNA. It is appreciated that VGR383 folded precursor RNA, herein designated VGR FOLDED PRECURSOR RNA, comprises a plurality of what is known in the art as hairpin structures. These hairpin structures are due to the fact that the nucleotide sequence of VGR383 precursor RNA comprises a plurality of segments, the first half of each such segment having a nucleotide sequence which is at least a partial inversed-reversed sequence of the second half thereof, as is well known in the art.

VGR383 folded precursor RNA, herein designated VGR FOLDED PRECURSOR RNA, is naturally processed by cellular enzymatic activity into at least 2 separate VGAM precursor RNAs, VGAM123 precursor RNA and VGAM124 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM123 RNA and VGAM124 RNA respectively, herein schematically represented by VGAM1 RNA and VGAM2 RNA respectively, each of which VGAM RNAs corresponding to VGAM RNA of FIG. 8.

VGAM123 RNA, herein schematically represented by VGAM1 binds complimentarily to a host target binding site located in an untranslated region of VGAM123 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM123 host target RNA, herein schematically represented by VGAM1 HOST TARGET RNA into VGAM123 host target protein, herein schematically represented by VGAM1 HOST TARGET PROTEIN, both of FIG. 1.

VGAM124 RNA, herein schematically represented by VGAM2 binds complimentarily to a host target binding site located in an untranslated region of VGAM124 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM124 host target RNA, herein schematically represented by VGAM2 HOST TARGET RNA into VGAM124 host target protein, herein schematically represented by VGAM2 HOST TARGET PROTEIN, both of FIG. 1.

It is appreciated that a function of VGR383 gene, herein designated VGR GENE, is inhibition of expression of host target genes, as part of a novel viral mechanism of attacking a host. Accordingly, utilities of VGR383 gene include diagnosis, prevention and treatment of viral infection by. Specific functions, and accordingly utilities, of VGR383 gene, herein designated VGR GENE, correlate with, and may be deduced from, the identity of the host target genes, which are inhibited by VGAM RNAs comprised in the operon-like cluster of VGR383 gene: VGAM123 host target protein and VGAM124 host target protein, herein schematically represented by VGAM1 HOST TARGET PROTEIN and VGAM HOST TARGET PROTEIN respectively. The function of these host target genes is elaborated hereinabove with reference to VGAM123 and VGAM124

FIG. 9 further provides a conceptual description of novel bioinformatically detected regulatory viral gene, referred to here as Viral Genomic Record 384(VGR384) viral gene, which encodes an operon-like cluster of novel viral micro RNA-like genes, each of which in turn modulates expression of at least one host target gene, the function and utility of which at least one host target gene is known in the art.

VGR384 gene, herein designated VGR GENE, is a novel bioinformatically detected regulatory, non protein coding, RNA viral gene. The method by which VGR384 gene was detected is described hereinabove with reference to FIGS. 6-15.

VGR384 gene encodes VGR384 precursor RNA, herein designated VGR PRECURSOR RNA, an RNA molecule, typically several hundred nucleotides long.

VGR384 precursor RNA folds spatially, forming VGR384 folded precursor RNA, herein designated VGR FOLDED PRECURSOR RNA. It is appreciated that VGR384 folded precursor RNA, herein designated VGR FOLDED PRECURSOR RNA, comprises a plurality of what is known in the art as hairpin structures. These hairpin structures are due to the fact that the nucleotide sequence of VGR384 precursor RNA comprises a plurality of segments, the first half of each such segment having a nucleotide sequence which is at least a partial inversed-reversed sequence of the second half thereof, as is well known in the art.

VGR384 folded precursor RNA, herein designated VGR FOLDED PRECURSOR RNA, is naturally processed by cellular enzymatic activity into at least 2 separate VGAM precursor RNAs, VGAM125 precursor RNA and VGAM126 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM125 RNA and VGAM126 RNA respectively, herein schematically represented by VGAM1 RNA and VGAM2 RNA respectively, each of which VGAM RNAs corresponding to VGAM RNA of FIG. 8.

VGAM125 RNA, herein schematically represented by VGAM1 binds complimentarily to a host target binding site located in an untranslated region of VGAM125 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM125 host target RNA, herein schematically represented by VGAM1 HOST TARGET RNA into VGAM125 host target protein, herein schematically represented by VGAM1 HOST TARGET PROTEIN, both of FIG. 1.

VGAM126 RNA, herein schematically represented by VGAM2 binds complimentarily to a host target binding site located in an untranslated region of VGAM126 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM126 host target RNA, herein schematically represented by VGAM2 HOST TARGET RNA into VGAM126 host target protein, herein schematically represented by VGAM2 HOST TARGET PROTEIN, both of FIG. 1.

It is appreciated that a function of VGR384 gene, herein designated VGR GENE, is inhibition of expression of host target genes, as part of a novel viral mechanism of attacking a host. Accordingly, utilities of VGR384 gene include diagnosis, prevention and treatment of viral infection by. Specific functions, and accordingly utilities, of VGR384 gene, herein designated VGR GENE, correlate with, and may be deduced from, the identity of the host target genes, which are inhibited by VGAM RNAs comprised in the operon-like cluster of VGR384 gene: VGAM125 host target protein and VGAM126 host target protein, herein schematically represented by VGAM1 HOST TARGET PROTEIN and VGAM HOST TARGET PROTEIN respectively. The function of these host target genes is elaborated hereinabove with reference to VGAM125 and VGAM126

FIG. 9 further provides a conceptual description of novel bioinformatically detected regulatory viral gene, referred to here as Viral Genomic Record 385(VGR385) viral gene, which encodes an operon-like cluster of novel viral micro RNA-like genes, each of which in turn modulates expression of at least one host target gene, the function and utility of which at least one host target gene is known in the art.

VGR385 gene, herein designated VGR GENE, is a novel bioinformatically detected regulatory, non protein coding, RNA viral gene. The method by which VGR385 gene was detected is described hereinabove with reference to FIGS. 6-15.

VGR385 gene encodes VGR385 precursor RNA, herein designated VGR PRECURSOR RNA, an RNA molecule, typically several hundred nucleotides long.

VGR385 precursor RNA folds spatially, forming VGR385 folded precursor RNA, herein designated VGR FOLDED PRECURSOR RNA. It is appreciated that VGR385 folded precursor RNA, herein designated VGR FOLDED PRECURSOR RNA, comprises a plurality of what is known in the art as hairpin structures. These hairpin structures are due to the fact that the nucleotide sequence of VGR385 precursor RNA comprises a plurality of segments, the first half of each such segment having a nucleotide sequence which is at least a partial inversed-reversed sequence of the second half thereof, as is well known in the art.

VGR385 folded precursor RNA, herein designated VGR FOLDED PRECURSOR RNA, is naturally processed by cellular enzymatic activity into at least 2 separate VGAM precursor RNAs, VGAM127 precursor RNA and VGAM128 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM127 RNA and VGAM128 RNA respectively, herein schematically represented by VGAM1 RNA and VGAM2 RNA respectively, each of which VGAM RNAs corresponding to VGAM RNA of FIG. 8.

VGAM127 RNA, herein schematically represented by VGAM1 binds complimentarily to a host target binding site located in an untranslated region of VGAM127 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM127 host target RNA, herein schematically represented by VGAM1 HOST TARGET RNA into VGAM127 host target protein, herein schematically represented by VGAM1 HOST TARGET PROTEIN, both of FIG. 1.

VGAM128 RNA, herein schematically represented by VGAM2 binds complimentarily to a host target binding site located in an untranslated region of VGAM128 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM128 host target RNA, herein schematically represented by VGAM2 HOST TARGET RNA into VGAM128 host target protein, herein schematically represented by VGAM2 HOST TARGET PROTEIN, both of FIG. 1.

It is appreciated that a function of VGR385 gene, herein designated VGR GENE, is inhibition of expression of host target genes, as part of a novel viral mechanism of attacking a host. Accordingly, utilities of VGR385 gene include diagnosis, prevention and treatment of viral infection by. Specific functions, and accordingly utilities, of VGR385 gene, herein designated VGR GENE, correlate with, and may be deduced from, the identity of the host target genes, which are inhibited by VGAM RNAs comprised in the operon-like cluster of VGR385 gene: VGAM127 host target protein and VGAM128 host target protein, herein schematically represented by VGAM1 HOST TARGET PROTEIN and VGAM HOST TARGET PROTEIN respectively. The function of these host target genes is elaborated hereinabove with reference to VGAM127 and VGAM128

FIG. 9 further provides a conceptual description of novel bioinformatically detected regulatory viral gene, referred to here as Viral Genomic Record 386(VGR386) viral gene, which encodes an operon-like cluster of novel viral micro RNA-like genes, each of which in turn modulates expression of at least one host target gene, the function and utility of which at least one host target gene is known in the art.

VGR386 gene, herein designated VGR GENE, is a novel bioinformatically detected regulatory, non protein coding, RNA viral gene. The method by which VGR386 gene was detected is described hereinabove with reference to FIGS. 6-15.

VGR386 gene encodes VGR386 precursor RNA, herein designated VGR PRECURSOR RNA, an RNA molecule, typically several hundred nucleotides long.

VGR386 precursor RNA folds spatially, forming VGR386 folded precursor RNA, herein designated VGR FOLDED PRECURSOR RNA. It is appreciated that VGR386 folded precursor RNA, herein designated VGR FOLDED PRECURSOR RNA, comprises a plurality of what is known in the art as hairpin structures. These hairpin structures are due to the fact that the nucleotide sequence of VGR386 precursor RNA comprises a plurality of segments, the first half of each such segment having a nucleotide sequence which is at least a partial inversed-reversed sequence of the second half thereof, as is well known in the art.

VGR386 folded precursor RNA, herein designated VGR FOLDED PRECURSOR RNA, is naturally processed by cellular enzymatic activity into at least 3 separate VGAM precursor RNAs, VGAM130 precursor RNA, VGAM131 precursor RNA and VGAM132 precursor RNA, herein schematically represented by VGAM1 PRECURSOR, VGAM2 PRECURSOR and VGAM3 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM130 RNA, VGAM131 RNA and VGAM132 RNA respectively, herein schematically represented by VGAM1 RNA, VGAM2 RNA and VGAM3 RNA respectively, each of which VGAM RNAs corresponding to VGAM RNA of FIG. 8.

VGAM130 RNA, herein schematically represented by VGAM1 binds complimentarily to a host target binding site located in an untranslated region of VGAM130 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM130 host target RNA, herein schematically represented by VGAM1 HOST TARGET RNA into VGAM130 host target protein, herein schematically represented by VGAM1 HOST TARGET PROTEIN, both of FIG. 1.

VGAM131 RNA, herein schematically represented by VGAM2 binds complimentarily to a host target binding site located in an untranslated region of VGAM131 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM131 host target RNA, herein schematically represented by VGAM2 HOST TARGET RNA into VGAM131 host target protein, herein schematically represented by VGAM2 HOST TARGET PROTEIN, both of FIG. 1.

VGAM132 RNA, herein schematically represented by VGAM3 binds complimentarily to a host target binding site located in an untranslated region of VGAM132 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM132 host target RNA, herein schematically represented by VGAM3 HOST TARGET RNA into VGAM132 host target protein, herein schematically represented by VGAM3 HOST TARGET PROTEIN, both of FIG. 1.

It is appreciated that a function of VGR386 gene, herein designated VGR GENE, is inhibition of expression of host target genes, as part of a novel viral mechanism of attacking a host. Accordingly, utilities of VGR386 gene include diagnosis, prevention and treatment of viral infection by. Specific functions, and accordingly utilities, of VGR386 gene, herein designated VGR GENE, correlate with, and may be deduced from, the identity of the host target genes, which are inhibited by VGAM RNAs comprised in the operon-like cluster of VGR386 gene: VGAM130 host target protein, VGAM131 host target protein and VGAM132 host target protein, herein schematically represented by VGAM1 HOST TARGET PROTEIN through VGAM HOST TARGET PROTEIN respectively. The function of these host target genes is elaborated hereinabove with reference to VGAM130, VGAM131 and VGAM132

FIG. 9 further provides a conceptual description of novel bioinformatically detected regulatory viral gene, referred to here as Viral Genomic Record 387(VGR387) viral gene, which encodes an operon-like cluster of novel viral micro RNA-like genes, each of which in turn modulates expression of at least one host target gene, the function and utility of which at least one host target gene is known in the art.

VGR387 gene, herein designated VGR GENE, is a novel bioinformatically detected regulatory, non protein coding, RNA viral gene. The method by which VGR387 gene was detected is described hereinabove with reference to FIGS. 6-15.

VGR387 gene encodes VGR387 precursor RNA, herein designated VGR PRECURSOR RNA, an RNA molecule, typically several hundred nucleotides long.

VGR387 precursor RNA folds spatially, forming VGR387 folded precursor RNA, herein designated VGR FOLDED PRECURSOR RNA. It is appreciated that VGR387 folded precursor RNA, herein designated VGR FOLDED PRECURSOR RNA, comprises a plurality of what is known in the art as hairpin structures. These hairpin structures are due to the fact that the nucleotide sequence of VGR387 precursor RNA comprises a plurality of segments, the first half of each such segment having a nucleotide sequence which is at least a partial inversed-reversed sequence of the second half thereof, as is well known in the art.

VGR387 folded precursor RNA, herein designated VGR FOLDED PRECURSOR RNA, is naturally processed by cellular enzymatic activity into at least 7 separate VGAM precursor RNAs, VGAM133 precursor RNA, VGAM134 precursor RNA, VGAM135 precursor RNA, VGAM136 precursor RNA, VGAM137 precursor RNA, VGAM138 precursor RNA and VGAM139 precursor RNA, herein schematically represented by VGAM1 PRECURSOR, VGAM2 PRECURSOR, VGAM3 PRECURSOR, VGAM4 PRECURSOR, VGAM5 PRECURSOR, VGAM6 PRECURSOR and VGAM7 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM133 RNA, VGAM134 RNA, VGAM135 RNA, VGAM136 RNA, VGAM137 RNA, VGAM138 RNA and VGAM139 RNA respectively, herein schematically represented by VGAM1 RNA, VGAM2 RNA, VGAM3 RNA, VGAM4 RNA, VGAM5 RNA, VGAM6 RNA and VGAM7 RNA respectively, each of which VGAM RNAs corresponding to VGAM RNA of FIG. 8.

VGAM133 RNA, herein schematically represented by VGAM1 binds complimentarily to a host target binding site located in an untranslated region of VGAM133 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM133 host target RNA, herein schematically represented by VGAM1 HOST TARGET RNA into VGAM133 host target protein, herein schematically represented by VGAM1 HOST TARGET PROTEIN, both of FIG. 1.

VGAM134 RNA, herein schematically represented by VGAM2 binds complimentarily to a host target binding site located in an untranslated region of VGAM134 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM134 host target RNA, herein schematically represented by VGAM2 HOST TARGET RNA into VGAM134 host target protein, herein schematically represented by VGAM2 HOST TARGET PROTEIN, both of FIG. 1.

VGAM135 RNA, herein schematically represented by VGAM3 binds complimentarily to a host target binding site located in an untranslated region of VGAM135 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM135 host target RNA, herein schematically represented by VGAM3 HOST TARGET RNA into VGAM135 host target protein, herein schematically represented by VGAM3 HOST TARGET PROTEIN, both of FIG. 1.

VGAM136 RNA, herein schematically represented by VGAM4 binds complimentarily to a host target binding site located in an untranslated region of VGAM136 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM136 host target RNA, herein schematically represented by VGAM4 HOST TARGET RNA into VGAM136 host target protein, herein schematically represented by VGAM4 HOST TARGET PROTEIN, both of FIG. 1.

VGAM137 RNA, herein schematically represented by VGAM5 binds complimentarily to a host target binding site located in an untranslated region of VGAM137 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM137 host target RNA, herein schematically represented by VGAM5 HOST TARGET RNA into VGAM137 host target protein, herein schematically represented by VGAM5 HOST TARGET PROTEIN, both of FIG. 1.

VGAM138 RNA, herein schematically represented by VGAM6 binds complimentarily to a host target binding site located in an untranslated region of VGAM138 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM138 host target RNA, herein schematically represented by VGAM6 HOST TARGET RNA into VGAM138 host target protein, herein schematically represented by VGAM6 HOST TARGET PROTEIN, both of FIG. 1.

VGAM139 RNA, herein schematically represented by VGAM7 binds complimentarily to a host target binding site located in an untranslated region of VGAM139 host target RNA, herein schematically represented by VGAM7 HOST TARGET RNA, which host target binding site corresponds to a host target binding site such as BINDING SITE I, BINDING SITE II or BINDING SITE III of FIG. 1, thereby inhibiting translation of VGAM139 host target RNA, herein schematically represented by VGAM7 HOST TARGET RNA into VGAM139 host target protein, herein schematically represented by VGAM7 HOST TARGET PROTEIN, both of FIG. 1.

It is appreciated that a function of VGR387 gene, herein designated VGR GENE, is inhibition of expression of host target genes, as part of a novel viral mechanism of attacking a host. Accordingly, utilities of VGR387 gene include diagnosis, prevention and treatment of viral infection by. Specific functions, and accordingly utilities, of VGR387 gene, herein designated VGR GENE, correlate with, and may be deduced from, the identity of the host target genes, which are inhibited by VGAM RNAs comprised in the operon-like cluster of VGR387 gene: VGAM133 host target protein, VGAM134 host target protein, VGAM135 host target protein, VGAM136 host target protein, VGAM137 host target protein, VGAM138 host target protein and VGAM139 host target protein, herein schematically represented by VGAM1 HOST TARGET PROTEIN through VGAM HOST TARGET PROTEIN respectively. The function of these host target genes is elaborated hereinabove with reference to VGAM133, VGAM134, VGAM135, VGAM136, VGAM137, VGAM138 and VGAM139

FIG. 9 further provides a conceptual description of novel bioinformatically detected regulatory viral gene, referred to here as Viral Genomic Record 388(VGR388) viral gene, which encodes an operon-like cluster of novel viral micro RNA-like genes, each of which in turn modulates expression of at least one host target gene, the function and utility of which at least one host target gene is known in the art.

VGR388 gene, herein designated VGR GENE, is a novel bioinformatically detected regulatory, non protein coding, RNA viral gene. The method by which VGR388 gene was detected is described hereinabove with reference to FIGS. 6-15.

VGR388 gene encodes VGR388 precursor RNA, herein designated VGR PRECURSOR RNA, an RNA molecule, typically several hundred nucleotides long.

VGR388 precursor RNA folds spatially, forming VGR388 folded precursor RNA, herein designated VGR FOLDED PRECURSOR RNA. It is appreciated that VGR388 folded precursor RNA, herein designated VGR FOLDED PRECURSOR RNA, comprises a plurality of what is known in the art as hairpin structures. These hairpin structures are due to the fact that the nucleotide sequence of VGR388 precursor RNA comprises a plurality of segments, the first half of each such segment having a nucleotide sequence which is at least a partial inversed-reversed sequence of the second half thereof, as is well known in the art.

VGR388 folded precursor RNA, herein designated VGR FOLDED PRECURSOR RNA, is naturally processed by cellular enzymatic activity into at least 2 separate VGAM precursor RNAs, VGAM140 precursor RNA and VGAM141 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM140 RNA and VGAM141 RNA respectively, herein schematically represented by VGAM1 RNA and VGAM2 RNA respectively, each of which VGAM RNAs corresponding to VGAM RNA of FIG. 8.

VGAM140 RNA, herein schematically represented by VGAM1 binds complimentarily to a host target binding site located in an untranslated region of VGAM140 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM140 host target RNA, herein schematically represented by VGAM1 HOST TARGET RNA into VGAM140 host target protein, herein schematically represented by VGAM1 HOST TARGET PROTEIN, both of FIG. 1.

VGAM141 RNA, herein schematically represented by VGAM2 binds complimentarily to a host target binding site located in an untranslated region of VGAM141 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM141 host target RNA, herein schematically represented by VGAM2 HOST TARGET RNA into VGAM141 host target protein, herein schematically represented by VGAM2 HOST TARGET PROTEIN, both of FIG. 1.

It is appreciated that a function of VGR388 gene, herein designated VGR GENE, is inhibition of expression of host target genes, as part of a novel viral mechanism of attacking a host. Accordingly, utilities of VGR388 gene include diagnosis, prevention and treatment of viral infection by. Specific functions, and accordingly utilities, of VGR388 gene, herein designated VGR GENE, correlate with, and may be deduced from, the identity of the host target genes, which are inhibited by VGAM RNAs comprised in the operon-like cluster of VGR388 gene: VGAM140 host target protein and VGAM141 host target protein, herein schematically represented by VGAM1 HOST TARGET PROTEIN and VGAM HOST TARGET PROTEIN respectively. The function of these host target genes is elaborated hereinabove with reference to VGAM140 and VGAM141

FIG. 9 further provides a conceptual description of novel bioinformatically detected regulatory viral gene, referred to here as Viral Genomic Record 389(VGR389) viral gene, which encodes an operon-like cluster of novel viral micro RNA-like genes, each of which in turn modulates expression of at least one host target gene, the function and utility of which at least one host target gene is known in the art.

VGR389 gene, herein designated VGR GENE, is a novel bioinformatically detected regulatory, non protein coding, RNA viral gene. The method by which VGR389 gene was detected is described hereinabove with reference to FIGS. 6-15.

VGR389 gene encodes VGR389 precursor RNA, herein designated VGR PRECURSOR RNA, an RNA molecule, typically several hundred nucleotides long.

VGR389 precursor RNA folds spatially, forming VGR389 folded precursor RNA, herein designated VGR FOLDED PRECURSOR RNA. It is appreciated that VGR389 folded precursor RNA, herein designated VGR FOLDED PRECURSOR RNA, comprises a plurality of what is known in the art as hairpin structures. These hairpin structures are due to the fact that the nucleotide sequence of VGR389 precursor RNA comprises a plurality of segments, the first half of each such segment having a nucleotide sequence which is at least a partial inversed-reversed sequence of the second half thereof, as is well known in the art.

VGR389 folded precursor RNA, herein designated VGR FOLDED PRECURSOR RNA, is naturally processed by cellular enzymatic activity into at least 6 separate VGAM precursor RNAs, VGAM142 precursor RNA, VGAM143 precursor RNA, VGAM144 precursor RNA, VGAM145 precursor RNA, VGAM146 precursor RNA and VGAM147 precursor RNA, herein schematically represented by VGAM1 PRECURSOR, VGAM2 PRECURSOR, VGAM3 PRECURSOR, VGAM4 PRECURSOR, VGAM5 PRECURSOR and VGAM6 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM142 RNA, VGAM143 RNA, VGAM144 RNA, VGAM145 RNA, VGAM146 RNA and VGAM147 RNA respectively, herein schematically represented by VGAM1 RNA, VGAM2 RNA, VGAM3 RNA, VGAM4 RNA, VGAM5 RNA and VGAM6 RNA respectively, each of which VGAM RNAs corresponding to VGAM RNA of FIG. 8.

VGAM142 RNA, herein schematically represented by VGAM1 binds complimentarily to a host target binding site located in an untranslated region of VGAM142 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM142 host target RNA, herein schematically represented by VGAM1 HOST TARGET RNA into VGAM142 host target protein, herein schematically represented by VGAM1 HOST TARGET PROTEIN, both of FIG. 1.

VGAM143 RNA, herein schematically represented by VGAM2 binds complimentarily to a host target binding site located in an untranslated region of VGAM143 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM143 host target RNA, herein schematically represented by VGAM2 HOST TARGET RNA into VGAM143 host target protein, herein schematically represented by VGAM2 HOST TARGET PROTEIN, both of FIG. 1.

VGAM144 RNA, herein schematically represented by VGAM3 binds complimentarily to a host target binding site located in an untranslated region of VGAM144 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM144 host target RNA, herein schematically represented by VGAM3 HOST TARGET RNA into VGAM144 host target protein, herein schematically represented by VGAM3 HOST TARGET PROTEIN, both of FIG. 1.

VGAM145 RNA, herein schematically represented by VGAM4 binds complimentarily to a host target binding site located in an untranslated region of VGAM145 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM145 host target RNA, herein schematically represented by VGAM4 HOST TARGET RNA into VGAM145 host target protein, herein schematically represented by VGAM4 HOST TARGET PROTEIN, both of FIG. 1.

VGAM146 RNA, herein schematically represented by VGAM5 binds complimentarily to a host target binding site located in an untranslated region of VGAM146 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM146 host target RNA, herein schematically represented by VGAM5 HOST TARGET RNA into VGAM146 host target protein, herein schematically represented by VGAM5 HOST TARGET PROTEIN, both of FIG. 1.

VGAM147 RNA, herein schematically represented by VGAM6 binds complimentarily to a host target binding site located in an untranslated region of VGAM147 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM147 host target RNA, herein schematically represented by VGAM6 HOST TARGET RNA into VGAM147 host target protein, herein schematically represented by VGAM6 HOST TARGET PROTEIN, both of FIG. 1.

It is appreciated that a function of VGR389 gene, herein designated VGR GENE, is inhibition of expression of host target genes, as part of a novel viral mechanism of attacking a host. Accordingly, utilities of VGR389 gene include diagnosis, prevention and treatment of viral infection by. Specific functions, and accordingly utilities, of VGR389 gene, herein designated VGR GENE, correlate with, and may be deduced from, the identity of the host target genes, which are inhibited by VGAM RNAs comprised in the operon-like cluster of VGR389 gene: VGAM142 host target protein, VGAM143 host target protein, VGAM144 host target protein, VGAM145 host target protein, VGAM146 host target protein and VGAM147 host target protein, herein schematically represented by VGAM1 HOST TARGET PROTEIN through VGAM HOST TARGET PROTEIN respectively. The function of these host target genes is elaborated hereinabove with reference to VGAM142, VGAM143, VGAM144, VGAM145, VGAM146 and VGAM147

FIG. 9 further provides a conceptual description of novel bioinformatically detected regulatory viral gene, referred to here as Viral Genomic Record 390(VGR390) viral gene, which encodes an operon-like cluster of novel viral micro RNA-like genes, each of which in turn modulates expression of at least one host target gene, the function and utility of which at least one host target gene is known in the art.

VGR390 gene, herein designated VGR GENE, is a novel bioinformatically detected regulatory, non protein coding, RNA viral gene. The method by which VGR390 gene was detected is described hereinabove with reference to FIGS. 6-15.

VGR390 gene encodes VGR390 precursor RNA, herein designated VGR PRECURSOR RNA, an RNA molecule, typically several hundred nucleotides long.

VGR390 precursor RNA folds spatially, forming VGR390 folded precursor RNA, herein designated VGR FOLDED PRECURSOR RNA. It is appreciated that VGR390 folded precursor RNA, herein designated VGR FOLDED PRECURSOR RNA, comprises a plurality of what is known in the art as hairpin structures. These hairpin structures are due to the fact that the nucleotide sequence of VGR390 precursor RNA comprises a plurality of segments, the first half of each such segment having a nucleotide sequence which is at least a partial inversed-reversed sequence of the second half thereof, as is well known in the art.

VGR390 folded precursor RNA, herein designated VGR FOLDED PRECURSOR RNA, is naturally processed by cellular enzymatic activity into at least 2 separate VGAM precursor RNAs, VGAM148 precursor RNA and VGAM149 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM148 RNA and VGAM149 RNA respectively, herein schematically represented by VGAM1 RNA and VGAM2 RNA respectively, each of which VGAM RNAs corresponding to VGAM RNA of FIG. 8.

VGAM148 RNA, herein schematically represented by VGAM1 binds complimentarily to a host target binding site located in an untranslated region of VGAM148 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM148 host target RNA, herein schematically represented by VGAM1 HOST TARGET RNA into VGAM148 host target protein, herein schematically represented by VGAM1 HOST TARGET PROTEIN, both of FIG. 1.

VGAM149 RNA, herein schematically represented by VGAM2 binds complimentarily to a host target binding site located in an untranslated region of VGAM149 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM149 host target RNA, herein schematically represented by VGAM2 HOST TARGET RNA into VGAM149 host target protein, herein schematically represented by VGAM2 HOST TARGET PROTEIN, both of FIG. 1.

It is appreciated that a function of VGR390 gene, herein designated VGR GENE, is inhibition of expression of host target genes, as part of a novel viral mechanism of attacking a host. Accordingly, utilities of VGR390 gene include diagnosis, prevention and treatment of viral infection by. Specific functions, and accordingly utilities, of VGR390 gene, herein designated VGR GENE, correlate with, and may be deduced from, the identity of the host target genes, which are inhibited by VGAM RNAs comprised in the operon-like cluster of VGR390 gene: VGAM148 host target protein and VGAM149 host target protein, herein schematically represented by VGAM1 HOST TARGET PROTEIN and VGAM HOST TARGET PROTEIN respectively. The function of these host target genes is elaborated hereinabove with reference to VGAM148 and VGAM149

FIG. 9 further provides a conceptual description of novel bioinformatically detected regulatory viral gene, referred to here as Viral Genomic Record 391(VGR391) viral gene, which encodes an operon-like cluster of novel viral micro RNA-like genes, each of which in turn modulates expression of at least one host target gene, the function and utility of which at least one host target gene is known in the art.

VGR391 gene, herein designated VGR GENE, is a novel bioinformatically detected regulatory, non protein coding, RNA viral gene. The method by which VGR391 gene was detected is described hereinabove with reference to FIGS. 6-15.

VGR391 gene encodes VGR391 precursor RNA, herein designated VGR PRECURSOR RNA, an RNA molecule, typically several hundred nucleotides long.

VGR391 precursor RNA folds spatially, forming VGR391 folded precursor RNA, herein designated VGR FOLDED PRECURSOR RNA. It is appreciated that VGR391 folded precursor RNA, herein designated VGR FOLDED PRECURSOR RNA, comprises a plurality of what is known in the art as hairpin structures. These hairpin structures are due to the fact that the nucleotide sequence of VGR391 precursor RNA comprises a plurality of segments, the first half of each such segment having a nucleotide sequence which is at least a partial inversed-reversed sequence of the second half thereof, as is well known in the art.

VGR391 folded precursor RNA, herein designated VGR FOLDED PRECURSOR RNA, is naturally processed by cellular enzymatic activity into at least 2 separate VGAM precursor RNAs, VGAM150 precursor RNA and VGAM151 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM150 RNA and VGAM151 RNA respectively, herein schematically represented by VGAM1 RNA and VGAM2 RNA respectively, each of which VGAM RNAs corresponding to VGAM RNA of FIG. 8.

VGAM150 RNA, herein schematically represented by VGAM1 binds complimentarily to a host target binding site located in an untranslated region of VGAM150 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM150 host target RNA, herein schematically represented by VGAM1 HOST TARGET RNA into VGAM150 host target protein, herein schematically represented by VGAM1 HOST TARGET PROTEIN, both of FIG. 1.

VGAM151 RNA, herein schematically represented by VGAM2 binds complimentarily to a host target binding site located in an untranslated region of VGAM151 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM151 host target RNA, herein schematically represented by VGAM2 HOST TARGET RNA into VGAM151 host target protein, herein schematically represented by VGAM2 HOST TARGET PROTEIN, both of FIG. 1.

It is appreciated that a function of VGR391 gene, herein designated VGR GENE, is inhibition of expression of host target genes, as part of a novel viral mechanism of attacking a host. Accordingly, utilities of VGR391 gene include diagnosis, prevention and treatment of viral infection by. Specific functions, and accordingly utilities, of VGR391 gene, herein designated VGR GENE, correlate with, and may be deduced from, the identity of the host target genes, which are inhibited by VGAM RNAs comprised in the operon-like cluster of VGR391 gene: VGAM150 host target protein and VGAM151 host target protein, herein schematically represented by VGAM1 HOST TARGET PROTEIN and VGAM HOST TARGET PROTEIN respectively. The function of these host target genes is elaborated hereinabove with reference to VGAM150 and VGAM151

FIG. 9 further provides a conceptual description of novel bioinformatically detected regulatory viral gene, referred to here as Viral Genomic Record 392(VGR392) viral gene, which encodes an operon-like cluster of novel viral micro RNA-like genes, each of which in turn modulates expression of at least one host target gene, the function and utility of which at least one host target gene is known in the art.

VGR392 gene, herein designated VGR GENE, is a novel bioinformatically detected regulatory, non protein coding, RNA viral gene. The method by which VGR392 gene was detected is described hereinabove with reference to FIGS. 6-15.

VGR392 gene encodes VGR392 precursor RNA, herein designated VGR PRECURSOR RNA, an RNA molecule, typically several hundred nucleotides long.

VGR392 precursor RNA folds spatially, forming VGR392 folded precursor RNA, herein designated VGR FOLDED PRECURSOR RNA. It is appreciated that VGR392 folded precursor RNA, herein designated VGR FOLDED PRECURSOR RNA, comprises a plurality of what is known in the art as hairpin structures. These hairpin structures are due to the fact that the nucleotide sequence of VGR392 precursor RNA comprises a plurality of segments, the first half of each such segment having a nucleotide sequence which is at least a partial inversed-reversed sequence of the second half thereof, as is well known in the art.

VGR392 folded precursor RNA, herein designated VGR FOLDED PRECURSOR RNA, is naturally processed by cellular enzymatic activity into at least 4 separate VGAM precursor RNAs, VGAM154 precursor RNA, VGAM155 precursor RNA, VGAM156 precursor RNA and VGAM157 precursor RNA, herein schematically represented by VGAM1 PRECURSOR, VGAM2 PRECURSOR, VGAM3 PRECURSOR and VGAM4 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM154 RNA, VGAM155 RNA, VGAM156 RNA and VGAM157 RNA respectively, herein schematically represented by VGAM1 RNA, VGAM2 RNA, VGAM3 RNA and VGAM4 RNA respectively, each of which VGAM RNAs corresponding to VGAM RNA of FIG. 8.

VGAM154 RNA, herein schematically represented by VGAM1 binds complimentarily to a host target binding site located in an untranslated region of VGAM154 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM154 host target RNA, herein schematically represented by VGAM1 HOST TARGET RNA into VGAM154 host target protein, herein schematically represented by VGAM1 HOST TARGET PROTEIN, both of FIG. 1.

VGAM155 RNA, herein schematically represented by VGAM2 binds complimentarily to a host target binding site located in an untranslated region of VGAM155 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM155 host target RNA, herein schematically represented by VGAM2 HOST TARGET RNA into VGAM155 host target protein, herein schematically represented by VGAM2 HOST TARGET PROTEIN, both of FIG. 1.

VGAM156 RNA, herein schematically represented by VGAM3 binds complimentarily to a host target binding site located in an untranslated region of VGAM156 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM156 host target RNA, herein schematically represented by VGAM3 HOST TARGET RNA into VGAM156 host target protein, herein schematically represented by VGAM3 HOST TARGET PROTEIN, both of FIG. 1.

VGAM157 RNA, herein schematically represented by VGAM4 binds complimentarily to a host target binding site located in an untranslated region of VGAM157 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM157 host target RNA, herein schematically represented by VGAM4 HOST TARGET RNA into VGAM157 host target protein, herein schematically represented by VGAM4 HOST TARGET PROTEIN, both of FIG. 1.

It is appreciated that a function of VGR392 gene, herein designated VGR GENE, is inhibition of expression of host target genes, as part of a novel viral mechanism of attacking a host. Accordingly, utilities of VGR392 gene include diagnosis, prevention and treatment of viral infection by. Specific functions, and accordingly utilities, of VGR392 gene, herein designated VGR GENE, correlate with, and may be deduced from, the identity of the host target genes, which are inhibited by VGAM RNAs comprised in the operon-like cluster of VGR392 gene: VGAM154 host target protein, VGAM155 host target protein, VGAM156 host target protein and VGAM157 host target protein, herein schematically represented by VGAM1 HOST TARGET PROTEIN through VGAM HOST TARGET PROTEIN respectively. The function of these host target genes is elaborated hereinabove with reference to VGAM154, VGAM155, VGAM156 and VGAM157

FIG. 9 further provides a conceptual description of novel bioinformatically detected regulatory viral gene, referred to here as Viral Genomic Record 393(VGR393) viral gene, which encodes an operon-like cluster of novel viral micro RNA-like genes, each of which in turn modulates expression of at least one host target gene, the function and utility of which at least one host target gene is known in the art.

VGR393 gene, herein designated VGR GENE, is a novel bioinformatically detected regulatory, non protein coding, RNA viral gene. The method by which VGR393 gene was detected is described hereinabove with reference to FIGS. 6-15.

VGR393 gene encodes VGR393 precursor RNA, herein designated VGR PRECURSOR RNA, an RNA molecule, typically several hundred nucleotides long.

VGR393 precursor RNA folds spatially, forming VGR393 folded precursor RNA, herein designated VGR FOLDED PRECURSOR RNA. It is appreciated that VGR393 folded precursor RNA, herein designated VGR FOLDED PRECURSOR RNA, comprises a plurality of what is known in the art as hairpin structures. These hairpin structures are due to the fact that the nucleotide sequence of VGR393 precursor RNA comprises a plurality of segments, the first half of each such segment having a nucleotide sequence which is at least a partial inversed-reversed sequence of the second half thereof, as is well known in the art.

VGR393 folded precursor RNA, herein designated VGR FOLDED PRECURSOR RNA, is naturally processed by cellular enzymatic activity into at least 5 separate VGAM precursor RNAs, VGAM158 precursor RNA, VGAM159 precursor RNA, VGAM160 precursor RNA, VGAM161 precursor RNA and VGAM162 precursor RNA, herein schematically represented by VGAM1 PRECURSOR, VGAM2 PRECURSOR, VGAM3 PRECURSOR, VGAM4 PRECURSOR and VGAM5 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM158 RNA, VGAM159 RNA, VGAM160 RNA, VGAM161 RNA and VGAM162 RNA respectively, herein schematically represented by VGAM1 RNA, VGAM2 RNA, VGAM3 RNA, VGAM4 RNA and VGAM5 RNA respectively, each of which VGAM RNAs corresponding to VGAM RNA of FIG. 8.

VGAM158 RNA, herein schematically represented by VGAM1 binds complimentarily to a host target binding site located in an untranslated region of VGAM158 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM158 host target RNA, herein schematically represented by VGAM1 HOST TARGET RNA into VGAM158 host target protein, herein schematically represented by VGAM1 HOST TARGET PROTEIN, both of FIG. 1.

VGAM159 RNA, herein schematically represented by VGAM2 binds complimentarily to a host target binding site located in an untranslated region of VGAM159 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM159 host target RNA, herein schematically represented by VGAM2 HOST TARGET RNA into VGAM159 host target protein, herein schematically represented by VGAM2 HOST TARGET PROTEIN, both of FIG. 1.

VGAM160 RNA, herein schematically represented by VGAM3 binds complimentarily to a host target binding site located in an untranslated region of VGAM160 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM160 host target RNA, herein schematically represented by VGAM3 HOST TARGET RNA into VGAM160 host target protein, herein schematically represented by VGAM3 HOST TARGET PROTEIN, both of FIG. 1.

VGAM161 RNA, herein schematically represented by VGAM4 binds complimentarily to a host target binding site located in an untranslated region of VGAM161 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM161 host target RNA, herein schematically represented by VGAM4 HOST TARGET RNA into VGAM161 host target protein, herein schematically represented by VGAM4 HOST TARGET PROTEIN, both of FIG. 1.

VGAM162 RNA, herein schematically represented by VGAM5 binds complimentarily to a host target binding site located in an untranslated region of VGAM162 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM162 host target RNA, herein schematically represented by VGAM5 HOST TARGET RNA into VGAM162 host target protein, herein schematically represented by VGAM5 HOST TARGET PROTEIN, both of FIG. 1.

It is appreciated that a function of VGR393 gene, herein designated VGR GENE, is inhibition of expression of host target genes, as part of a novel viral mechanism of attacking a host. Accordingly, utilities of VGR393 gene include diagnosis, prevention and treatment of viral infection by. Specific functions, and accordingly utilities, of VGR393 gene, herein designated VGR GENE, correlate with, and may be deduced from, the identity of the host target genes, which are inhibited by VGAM RNAs comprised in the operon-like cluster of VGR393 gene: VGAM158 host target protein, VGAM159 host target protein, VGAM160 host target protein, VGAM161 host target protein and VGAM162 host target protein, herein schematically represented by VGAM1 HOST TARGET PROTEIN through VGAM HOST TARGET PROTEIN respectively. The function of these host target genes is elaborated hereinabove with reference to VGAM158, VGAM159, VGAM160, VGAM161 and VGAM162

FIG. 9 further provides a conceptual description of novel bioinformatically detected regulatory viral gene, referred to here as Viral Genomic Record 394(VGR394) viral gene, which encodes an operon-like cluster of novel viral micro RNA-like genes, each of which in turn modulates expression of at least one host target gene, the function and utility of which at least one host target gene is known in the art.

VGR394 gene, herein designated VGR GENE, is a novel bioinformatically detected regulatory, non protein coding, RNA viral gene. The method by which VGR394 gene was detected is described hereinabove with reference to FIGS. 6-15.

VGR394 gene encodes VGR394 precursor RNA, herein designated VGR PRECURSOR RNA, an RNA molecule, typically several hundred nucleotides long.

VGR394 precursor RNA folds spatially, forming VGR394 folded precursor RNA, herein designated VGR FOLDED PRECURSOR RNA. It is appreciated that VGR394 folded precursor RNA, herein designated VGR FOLDED PRECURSOR RNA, comprises a plurality of what is known in the art as hairpin structures. These hairpin structures are due to the fact that the nucleotide sequence of VGR394 precursor RNA comprises a plurality of segments, the first half of each such segment having a nucleotide sequence which is at least a partial inversed-reversed sequence of the second half thereof, as is well known in the art.

VGR394 folded precursor RNA, herein designated VGR FOLDED PRECURSOR RNA, is naturally processed by cellular enzymatic activity into at least 6 separate VGAM precursor RNAs, VGAM163 precursor RNA, VGAM164 precursor RNA, VGAM165 precursor RNA, VGAM166 precursor RNA, VGAM167 precursor RNA and VGAM168 precursor RNA, herein schematically represented by VGAM1 PRECURSOR, VGAM2 PRECURSOR, VGAM3 PRECURSOR, VGAM4 PRECURSOR, VGAM5 PRECURSOR and VGAM6 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM163 RNA, VGAM164 RNA, VGAM165 RNA, VGAM166 RNA, VGAM167 RNA and VGAM168 RNA respectively, herein schematically represented by VGAM1 RNA, VGAM2 RNA, VGAM3 RNA, VGAM4 RNA, VGAM5 RNA and VGAM6 RNA respectively, each of which VGAM RNAs corresponding to VGAM RNA of FIG. 8.

VGAM163 RNA, herein schematically represented by VGAM1 binds complimentarily to a host target binding site located in an untranslated region of VGAM163 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM163 host target RNA, herein schematically represented by VGAM1 HOST TARGET RNA into VGAM163 host target protein, herein schematically represented by VGAM1 HOST TARGET PROTEIN, both of FIG. 1.

VGAM164 RNA, herein schematically represented by VGAM2 binds complimentarily to a host target binding site located in an untranslated region of VGAM164 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM164 host target RNA, herein schematically represented by VGAM2 HOST TARGET RNA into VGAM164 host target protein, herein schematically represented by VGAM2 HOST TARGET PROTEIN, both of FIG. 1.

VGAM165 RNA, herein schematically represented by VGAM3 binds complimentarily to a host target binding site located in an untranslated region of VGAM165 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM165 host target RNA, herein schematically represented by VGAM3 HOST TARGET RNA into VGAM165 host target protein, herein schematically represented by VGAM3 HOST TARGET PROTEIN, both of FIG. 1.

VGAM166 RNA, herein schematically represented by VGAM4 binds complimentarily to a host target binding site located in an untranslated region of VGAM166 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM166 host target RNA, herein schematically represented by VGAM4 HOST TARGET RNA into VGAM166 host target protein, herein schematically represented by VGAM4 HOST TARGET PROTEIN, both of FIG. 1.

VGAM167 RNA, herein schematically represented by VGAM5 binds complimentarily to a host target binding site located in an untranslated region of VGAM167 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM167 host target RNA, herein schematically represented by VGAM5 HOST TARGET RNA into VGAM167 host target protein, herein schematically represented by VGAM5 HOST TARGET PROTEIN, both of FIG. 1.

VGAM168 RNA, herein schematically represented by VGAM6 binds complimentarily to a host target binding site located in an untranslated region of VGAM168 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM168 host target RNA, herein schematically represented by VGAM6 HOST TARGET RNA into VGAM168 host target protein, herein schematically represented by VGAM6 HOST TARGET PROTEIN, both of FIG. 1.

It is appreciated that a function of VGR394 gene, herein designated VGR GENE, is inhibition of expression of host target genes, as part of a novel viral mechanism of attacking a host. Accordingly, utilities of VGR394 gene include diagnosis, prevention and treatment of viral infection by. Specific functions, and accordingly utilities, of VGR394 gene, herein designated VGR GENE, correlate with, and may be deduced from, the identity of the host target genes, which are inhibited by VGAM RNAs comprised in the operon-like cluster of VGR394 gene: VGAM163 host target protein, VGAM164 host target protein, VGAM165 host target protein, VGAM166 host target protein, VGAM167 host target protein and VGAM168 host target protein, herein schematically represented by VGAM1 HOST TARGET PROTEIN through VGAM HOST TARGET PROTEIN respectively. The function of these host target genes is elaborated hereinabove with reference to VGAM163, VGAM164, VGAM165, VGAM166, VGAM167 and VGAM168

FIG. 9 further provides a conceptual description of novel bioinformatically detected regulatory viral gene, referred to here as Viral Genomic Record 395(VGR395) viral gene, which encodes an operon-like cluster of novel viral micro RNA-like genes, each of which in turn modulates expression of at least one host target gene, the function and utility of which at least one host target gene is known in the art.

VGR395 gene, herein designated VGR GENE, is a novel bioinformatically detected regulatory, non protein coding, RNA viral gene. The method by which VGR395 gene was detected is described hereinabove with reference to FIGS. 6-15.

VGR395 gene encodes VGR395 precursor RNA, herein designated VGR PRECURSOR RNA, an RNA molecule, typically several hundred nucleotides long.

VGR395 precursor RNA folds spatially, forming VGR395 folded precursor RNA, herein designated VGR FOLDED PRECURSOR RNA. It is appreciated that VGR395 folded precursor RNA, herein designated VGR FOLDED PRECURSOR RNA, comprises a plurality of what is known in the art as hairpin structures. These hairpin structures are due to the fact that the nucleotide sequence of VGR395 precursor RNA comprises a plurality of segments, the first half of each such segment having a nucleotide sequence which is at least a partial inversed-reversed sequence of the second half thereof, as is well known in the art.

VGR395 folded precursor RNA, herein designated VGR FOLDED PRECURSOR RNA, is naturally processed by cellular enzymatic activity into at least 2 separate VGAM precursor RNAs, VGAM169 precursor RNA and VGAM170 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM169 RNA and VGAM170 RNA respectively, herein schematically represented by VGAM1 RNA and VGAM2 RNA respectively, each of which VGAM RNAs corresponding to VGAM RNA of FIG. 8.

VGAM169 RNA, herein schematically represented by VGAM1 binds complimentarily to a host target binding site located in an untranslated region of VGAM169 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM169 host target RNA, herein schematically represented by VGAM1 HOST TARGET RNA into VGAM169 host target protein, herein schematically represented by VGAM1 HOST TARGET PROTEIN, both of FIG. 1.

VGAM170 RNA, herein schematically represented by VGAM2 binds complimentarily to a host target binding site located in an untranslated region of VGAM170 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM170 host target RNA, herein schematically represented by VGAM2 HOST TARGET RNA into VGAM170 host target protein, herein schematically represented by VGAM2 HOST TARGET PROTEIN, both of FIG. 1.

It is appreciated that a function of VGR395 gene, herein designated VGR GENE, is inhibition of expression of host target genes, as part of a novel viral mechanism of attacking a host. Accordingly, utilities of VGR395 gene include diagnosis, prevention and treatment of viral infection by. Specific functions, and accordingly utilities, of VGR395 gene, herein designated VGR GENE, correlate with, and may be deduced from, the identity of the host target genes, which are inhibited by VGAM RNAs comprised in the operon-like cluster of VGR395 gene: VGAM169 host target protein and VGAM170 host target protein, herein schematically represented by VGAM1 HOST TARGET PROTEIN and VGAM HOST TARGET PROTEIN respectively. The function of these host target genes is elaborated hereinabove with reference to VGAM169 and VGAM170

FIG. 9 further provides a conceptual description of novel bioinformatically detected regulatory viral gene, referred to here as Viral Genomic Record 396(VGR396) viral gene, which encodes an operon-like cluster of novel viral micro RNA-like genes, each of which in turn modulates expression of at least one host target gene, the function and utility of which at least one host target gene is known in the art.

VGR396 gene, herein designated VGR GENE, is a novel bioinformatically detected regulatory, non protein coding, RNA viral gene. The method by which VGR396 gene was detected is described hereinabove with reference to FIGS. 6-15.

VGR396 gene encodes VGR396 precursor RNA, herein designated VGR PRECURSOR RNA, an RNA molecule, typically several hundred nucleotides long.

VGR396 precursor RNA folds spatially, forming VGR396 folded precursor RNA, herein designated VGR FOLDED PRECURSOR RNA. It is appreciated that VGR396 folded precursor RNA, herein designated VGR FOLDED PRECURSOR RNA, comprises a plurality of what is known in the art as hairpin structures. These hairpin structures are due to the fact that the nucleotide sequence of VGR396 precursor RNA comprises a plurality of segments, the first half of each such segment having a nucleotide sequence which is at least a partial inversed-reversed sequence of the second half thereof, as is well known in the art.

VGR396 folded precursor RNA, herein designated VGR FOLDED PRECURSOR RNA, is naturally processed by cellular enzymatic activity into at least 2 separate VGAM precursor RNAs, VGAM171 precursor RNA and VGAM172 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM171 RNA and VGAM172 RNA respectively, herein schematically represented by VGAM1 RNA and VGAM2 RNA respectively, each of which VGAM RNAs corresponding to VGAM RNA of FIG. 8.

VGAM171 RNA, herein schematically represented by VGAM1 binds complimentarily to a host target binding site located in an untranslated region of VGAM171 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM171 host target RNA, herein schematically represented by VGAM1 HOST TARGET RNA into VGAM171 host target protein, herein schematically represented by VGAM1 HOST TARGET PROTEIN, both of FIG. 1.

VGAM172 RNA, herein schematically represented by VGAM2 binds complimentarily to a host target binding site located in an untranslated region of VGAM172 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM172 host target RNA, herein schematically represented by VGAM2 HOST TARGET RNA into VGAM172 host target protein, herein schematically represented by VGAM2 HOST TARGET PROTEIN, both of FIG. 1.

It is appreciated that a function of VGR396 gene, herein designated VGR GENE, is inhibition of expression of host target genes, as part of a novel viral mechanism of attacking a host. Accordingly, utilities of VGR396 gene include diagnosis, prevention and treatment of viral infection by. Specific functions, and accordingly utilities, of VGR396 gene, herein designated VGR GENE, correlate with, and may be deduced from, the identity of the host target genes, which are inhibited by VGAM RNAs comprised in the operon-like cluster of VGR396 gene: VGAM171 host target protein and VGAM172 host target protein, herein schematically represented by VGAM1 HOST TARGET PROTEIN and VGAM HOST TARGET PROTEIN respectively. The function of these host target genes is elaborated hereinabove with reference to VGAM171 and VGAM172

FIG. 9 further provides a conceptual description of novel bioinformatically detected regulatory viral gene, referred to here as Viral Genomic Record 397(VGR397) viral gene, which encodes an operon-like cluster of novel viral micro RNA-like genes, each of which in turn modulates expression of at least one host target gene, the function and utility of which at least one host target gene is known in the art.

VGR397 gene, herein designated VGR GENE, is a novel bioinformatically detected regulatory, non protein coding, RNA viral gene. The method by which VGR397 gene was detected is described hereinabove with reference to FIGS. 6-15.

VGR397 gene encodes VGR397 precursor RNA, herein designated VGR PRECURSOR RNA, an RNA molecule, typically several hundred nucleotides long.

VGR397 precursor RNA folds spatially, forming VGR397 folded precursor RNA, herein designated VGR FOLDED PRECURSOR RNA. It is appreciated that VGR397 folded precursor RNA, herein designated VGR FOLDED PRECURSOR RNA, comprises a plurality of what is known in the art as hairpin structures. These hairpin structures are due to the fact that the nucleotide sequence of VGR397 precursor RNA comprises a plurality of segments, the first half of each such segment having a nucleotide sequence which is at least a partial inversed-reversed sequence of the second half thereof, as is well known in the art.

VGR397 folded precursor RNA, herein designated VGR FOLDED PRECURSOR RNA, is naturally processed by cellular enzymatic activity into at least 2 separate VGAM precursor RNAs, VGAM173 precursor RNA and VGAM174 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM173 RNA and VGAM174 RNA respectively, herein schematically represented by VGAM1 RNA and VGAM2 RNA respectively, each of which VGAM RNAs corresponding to VGAM RNA of FIG. 8.

VGAM173 RNA, herein schematically represented by VGAM1 binds complimentarily to a host target binding site located in an untranslated region of VGAM173 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM173 host target RNA, herein schematically represented by VGAM1 HOST TARGET RNA into VGAM173 host target protein, herein schematically represented by VGAM1 HOST TARGET PROTEIN, both of FIG. 1.

VGAM174 RNA, herein schematically represented by VGAM2 binds complimentarily to a host target binding site located in an untranslated region of VGAM174 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM174 host target RNA, herein schematically represented by VGAM2 HOST TARGET RNA into VGAM174 host target protein, herein schematically represented by VGAM2 HOST TARGET PROTEIN, both of FIG. 1.

It is appreciated that a function of VGR397 gene, herein designated VGR GENE, is inhibition of expression of host target genes, as part of a novel viral mechanism of attacking a host. Accordingly, utilities of VGR397 gene include diagnosis, prevention and treatment of viral infection by. Specific functions, and accordingly utilities, of VGR397 gene, herein designated VGR GENE, correlate with, and may be deduced from, the identity of the host target genes, which are inhibited by VGAM RNAs comprised in the operon-like cluster of VGR397 gene: VGAM173 host target protein and VGAM174 host target protein, herein schematically represented by VGAM1 HOST TARGET PROTEIN and VGAM HOST TARGET PROTEIN respectively. The function of these host target genes is elaborated hereinabove with reference to VGAM173 and VGAM174

FIG. 9 further provides a conceptual description of novel bioinformatically detected regulatory viral gene, referred to here as Viral Genomic Record 398(VGR398) viral gene, which encodes an operon-like cluster of novel viral micro RNA-like genes, each of which in turn modulates expression of at least one host target gene, the function and utility of which at least one host target gene is known in the art.

VGR398 gene, herein designated VGR GENE, is a novel bioinformatically detected regulatory, non protein coding, RNA viral gene. The method by which VGR398 gene was detected is described hereinabove with reference to FIGS. 6-15.

VGR398 gene encodes VGR398 precursor RNA, herein designated VGR PRECURSOR RNA, an RNA molecule, typically several hundred nucleotides long.

VGR398 precursor RNA folds spatially, forming VGR398 folded precursor RNA, herein designated VGR FOLDED PRECURSOR RNA. It is appreciated that VGR398 folded precursor RNA, herein designated VGR FOLDED PRECURSOR RNA, comprises a plurality of what is known in the art as hairpin structures. These hairpin structures are due to the fact that the nucleotide sequence of VGR398 precursor RNA comprises a plurality of segments, the first half of each such segment having a nucleotide sequence which is at least a partial inversed-reversed sequence of the second half thereof, as is well known in the art.

VGR398 folded precursor RNA, herein designated VGR FOLDED PRECURSOR RNA, is naturally processed by cellular enzymatic activity into at least 2 separate VGAM precursor RNAs, VGAM175 precursor RNA and VGAM176 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM175 RNA and VGAM176 RNA respectively, herein schematically represented by VGAM1 RNA and VGAM2 RNA respectively, each of which VGAM RNAs corresponding to VGAM RNA of FIG. 8.

VGAM175 RNA, herein schematically represented by VGAM1 binds complimentarily to a host target binding site located in an untranslated region of VGAM175 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM175 host target RNA, herein schematically represented by VGAM1 HOST TARGET RNA into VGAM175 host target protein, herein schematically represented by VGAM1 HOST TARGET PROTEIN, both of FIG. 1.

VGAM176 RNA, herein schematically represented by VGAM2 binds complimentarily to a host target binding site located in an untranslated region of VGAM176 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM176 host target RNA, herein schematically represented by VGAM2 HOST TARGET RNA into VGAM176 host target protein, herein schematically represented by VGAM2 HOST TARGET PROTEIN, both of FIG. 1.

It is appreciated that a function of VGR398 gene, herein designated VGR GENE, is inhibition of expression of host target genes, as part of a novel viral mechanism of attacking a host. Accordingly, utilities of VGR398 gene include diagnosis, prevention and treatment of viral infection by. Specific functions, and accordingly utilities, of VGR398 gene, herein designated VGR GENE, correlate with, and may be deduced from, the identity of the host target genes, which are inhibited by VGAM RNAs comprised in the operon-like cluster of VGR398 gene: VGAM175 host target protein and VGAM176 host target protein, herein schematically represented by VGAM1 HOST TARGET PROTEIN and VGAM HOST TARGET PROTEIN respectively. The function of these host target genes is elaborated hereinabove with reference to VGAM175 and VGAM176

FIG. 9 further provides a conceptual description of novel bioinformatically detected regulatory viral gene, referred to here as Viral Genomic Record 399(VGR399) viral gene, which encodes an operon-like cluster of novel viral micro RNA-like genes, each of which in turn modulates expression of at least one host target gene, the function and utility of which at least one host target gene is known in the art.

VGR399 gene, herein designated VGR GENE, is a novel bioinformatically detected regulatory, non protein coding, RNA viral gene. The method by which VGR399 gene was detected is described hereinabove with reference to FIGS. 6-15.

VGR399 gene encodes VGR399 precursor RNA, herein designated VGR PRECURSOR RNA, an RNA molecule, typically several hundred nucleotides long.

VGR399 precursor RNA folds spatially, forming VGR399 folded precursor RNA, herein designated VGR FOLDED PRECURSOR RNA. It is appreciated that VGR399 folded precursor RNA, herein designated VGR FOLDED PRECURSOR RNA, comprises a plurality of what is known in the art as hairpin structures. These hairpin structures are due to the fact that the nucleotide sequence of VGR399 precursor RNA comprises a plurality of segments, the first half of each such segment having a nucleotide sequence which is at least a partial inversed-reversed sequence of the second half thereof, as is well known in the art.

VGR399 folded precursor RNA, herein designated VGR FOLDED PRECURSOR RNA, is naturally processed by cellular enzymatic activity into at least 4 separate VGAM precursor RNAs, VGAM177 precursor RNA, VGAM178 precursor RNA, VGAM179 precursor RNA and VGAM180 precursor RNA, herein schematically represented by VGAM1 PRECURSOR, VGAM2 PRECURSOR, VGAM3 PRECURSOR and VGAM4 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM177 RNA, VGAM178 RNA, VGAM179 RNA and VGAM180 RNA respectively, herein schematically represented by VGAM1 RNA, VGAM2 RNA, VGAM3 RNA and VGAM4 RNA respectively, each of which VGAM RNAs corresponding to VGAM RNA of FIG. 8.

VGAM177 RNA, herein schematically represented by VGAM1 binds complimentarily to a host target binding site located in an untranslated region of VGAM177 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM177 host target RNA, herein schematically represented by VGAM1 HOST TARGET RNA into VGAM177 host target protein, herein schematically represented by VGAM1 HOST TARGET PROTEIN, both of FIG. 1.

VGAM178 RNA, herein schematically represented by VGAM2 binds complimentarily to a host target binding site located in an untranslated region of VGAM178 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM178 host target RNA, herein schematically represented by VGAM2 HOST TARGET RNA into VGAM178 host target protein, herein schematically represented by VGAM2 HOST TARGET PROTEIN, both of FIG. 1.

VGAM179 RNA, herein schematically represented by VGAM3 binds complimentarily to a host target binding site located in an untranslated region of VGAM179 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM179 host target RNA, herein schematically represented by VGAM3 HOST TARGET RNA into VGAM179 host target protein, herein schematically represented by VGAM3 HOST TARGET PROTEIN, both of FIG. 1.

VGAM180 RNA, herein schematically represented by VGAM4 binds complimentarily to a host target binding site located in an untranslated region of VGAM180 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM180 host target RNA, herein schematically represented by VGAM4 HOST TARGET RNA into VGAM180 host target protein, herein schematically represented by VGAM4 HOST TARGET PROTEIN, both of FIG. 1.

It is appreciated that a function of VGR399 gene, herein designated VGR GENE, is inhibition of expression of host target genes, as part of a novel viral mechanism of attacking a host. Accordingly, utilities of VGR399 gene include diagnosis, prevention and treatment of viral infection by. Specific functions, and accordingly utilities, of VGR399 gene, herein designated VGR GENE, correlate with, and may be deduced from, the identity of the host target genes, which are inhibited by VGAM RNAs comprised in the operon-like cluster of VGR399 gene: VGAM177 host target protein, VGAM178 host target protein, VGAM179 host target protein and VGAM180 host target protein, herein schematically represented by VGAM1 HOST TARGET PROTEIN through VGAM HOST TARGET PROTEIN respectively. The function of these host target genes is elaborated hereinabove with reference to VGAM177, VGAM178, VGAM179 and VGAM180

FIG. 9 further provides a conceptual description of novel bioinformatically detected regulatory viral gene, referred to here as Viral Genomic Record 400(VGR400) viral gene, which encodes an operon-like cluster of novel viral micro RNA-like genes, each of which in turn modulates expression of at least one host target gene, the function and utility of which at least one host target gene is known in the art.

VGR400 gene, herein designated VGR GENE, is a novel bioinformatically detected regulatory, non protein coding, RNA viral gene. The method by which VGR400 gene was detected is described hereinabove with reference to FIGS. 6-15.

VGR400 gene encodes VGR400 precursor RNA, herein designated VGR PRECURSOR RNA, an RNA molecule, typically several hundred nucleotides long.

VGR400 precursor RNA folds spatially, forming VGR400 folded precursor RNA, herein designated VGR FOLDED PRECURSOR RNA. It is appreciated that VGR400 folded precursor RNA, herein designated VGR FOLDED PRECURSOR RNA, comprises a plurality of what is known in the art as hairpin structures. These hairpin structures are due to the fact that the nucleotide sequence of VGR400 precursor RNA comprises a plurality of segments, the first half of each such segment having a nucleotide sequence which is at least a partial inversed-reversed sequence of the second half thereof, as is well known in the art.

VGR400 folded precursor RNA, herein designated VGR FOLDED PRECURSOR RNA, is naturally processed by cellular enzymatic activity into at least 7 separate VGAM precursor RNAs, VGAM181 precursor RNA, VGAM182 precursor RNA, VGAM183 precursor RNA, VGAM184 precursor RNA, VGAM185 precursor RNA, VGAM186 precursor RNA and VGAM187 precursor RNA, herein schematically represented by VGAM1 PRECURSOR, VGAM2 PRECURSOR, VGAM3 PRECURSOR, VGAM4 PRECURSOR, VGAM5 PRECURSOR, VGAM6 PRECURSOR and VGAM7 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM181 RNA, VGAM182 RNA, VGAM183 RNA, VGAM184 RNA, VGAM185 RNA, VGAM186 RNA and VGAM187 RNA respectively, herein schematically represented by VGAM1 RNA, VGAM2 RNA, VGAM3 RNA, VGAM4 RNA, VGAM5 RNA, VGAM6 RNA and VGAM7 RNA respectively, each of which VGAM RNAs corresponding to VGAM RNA of FIG. 8.

VGAM181 RNA, herein schematically represented by VGAM1 binds complimentarily to a host target binding site located in an untranslated region of VGAM181 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM181 host target RNA, herein schematically represented by VGAM1 HOST TARGET RNA into VGAM181 host target protein, herein schematically represented by VGAM1 HOST TARGET PROTEIN, both of FIG. 1.

VGAM182 RNA, herein schematically represented by VGAM2 binds complimentarily to a host target binding site located in an untranslated region of VGAM182 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM182 host target RNA, herein schematically represented by VGAM2 HOST TARGET RNA into VGAM182 host target protein, herein schematically represented by VGAM2 HOST TARGET PROTEIN, both of FIG. 1.

VGAM183 RNA, herein schematically represented by VGAM3 binds complimentarily to a host target binding site located in an untranslated region of VGAM183 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM183 host target RNA, herein schematically represented by VGAM3 HOST TARGET RNA into VGAM183 host target protein, herein schematically represented by VGAM3 HOST TARGET PROTEIN, both of FIG. 1.

VGAM184 RNA, herein schematically represented by VGAM4 binds complimentarily to a host target binding site located in an untranslated region of VGAM184 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM184 host target RNA, herein schematically represented by VGAM4 HOST TARGET RNA into VGAM184 host target protein, herein schematically represented by VGAM4 HOST TARGET PROTEIN, both of FIG. 1.

VGAM185 RNA, herein schematically represented by VGAM5 binds complimentarily to a host target binding site located in an untranslated region of VGAM185 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM185 host target RNA, herein schematically represented by VGAM5 HOST TARGET RNA into VGAM185 host target protein, herein schematically represented by VGAM5 HOST TARGET PROTEIN, both of FIG. 1.

VGAM186 RNA, herein schematically represented by VGAM6 binds complimentarily to a host target binding site located in an untranslated region of VGAM186 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM186 host target RNA, herein schematically represented by VGAM6 HOST TARGET RNA into VGAM186 host target protein, herein schematically represented by VGAM6 HOST TARGET PROTEIN, both of FIG. 1.

VGAM187 RNA, herein schematically represented by VGAM7 binds complimentarily to a host target binding site located in an untranslated region of VGAM187 host target RNA, herein schematically represented by VGAM7 HOST TARGET RNA, which host target binding site corresponds to a host target binding site such as BINDING SITE I, BINDING SITE II or BINDING SITE III of FIG. 1, thereby inhibiting translation of VGAM187 host target RNA, herein schematically represented by VGAM7 HOST TARGET RNA into VGAM187 host target protein, herein schematically represented by VGAM7 HOST TARGET PROTEIN, both of FIG. 1.

It is appreciated that a function of VGR400 gene, herein designated VGR GENE, is inhibition of expression of host target genes, as part of a novel viral mechanism of attacking a host. Accordingly, utilities of VGR400 gene include diagnosis, prevention and treatment of viral infection by. Specific functions, and accordingly utilities, of VGR400 gene, herein designated VGR GENE, correlate with, and may be deduced from, the identity of the host target genes, which are inhibited by VGAM RNAs comprised in the operon-like cluster of VGR400 gene: VGAM181 host target protein, VGAM182 host target protein, VGAM183 host target protein, VGAM184 host target protein, VGAM185 host target protein, VGAM186 host target protein and VGAM187 host target protein, herein schematically represented by VGAM1 HOST TARGET PROTEIN through VGAM HOST TARGET PROTEIN respectively. The function of these host target genes is elaborated hereinabove with reference to VGAM181, VGAM182, VGAM183, VGAM184, VGAM185, VGAM186 and VGAM187

FIG. 9 further provides a conceptual description of novel bioinformatically detected regulatory viral gene, referred to here as Viral Genomic Record 401(VGR401) viral gene, which encodes an operon-like cluster of novel viral micro RNA-like genes, each of which in turn modulates expression of at least one host target gene, the function and utility of which at least one host target gene is known in the art.

VGR401 gene, herein designated VGR GENE, is a novel bioinformatically detected regulatory, non protein coding, RNA viral gene. The method by which VGR401 gene was detected is described hereinabove with reference to FIGS. 6-15.

VGR401 gene encodes VGR401 precursor RNA, herein designated VGR PRECURSOR RNA, an RNA molecule, typically several hundred nucleotides long.

VGR401 precursor RNA folds spatially, forming VGR401 folded precursor RNA, herein designated VGR FOLDED PRECURSOR RNA. It is appreciated that VGR401 folded precursor RNA, herein designated VGR FOLDED PRECURSOR RNA, comprises a plurality of what is known in the art as hairpin structures. These hairpin structures are due to the fact that the nucleotide sequence of VGR401 precursor RNA comprises a plurality of segments, the first half of each such segment having a nucleotide sequence which is at least a partial inversed-reversed sequence of the second half thereof, as is well known in the art.

VGR401 folded precursor RNA, herein designated VGR FOLDED PRECURSOR RNA, is naturally processed by cellular enzymatic activity into at least 2 separate VGAM precursor RNAs, VGAM188 precursor RNA and VGAM189 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM188 RNA and VGAM189 RNA respectively, herein schematically represented by VGAM1 RNA and VGAM2 RNA respectively, each of which VGAM RNAs corresponding to VGAM RNA of FIG. 8.

VGAM188 RNA, herein schematically represented by VGAM1 binds complimentarily to a host target binding site located in an untranslated region of VGAM188 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM188 host target RNA, herein schematically represented by VGAM1 HOST TARGET RNA into VGAM188 host target protein, herein schematically represented by VGAM1 HOST TARGET PROTEIN, both of FIG. 1.

VGAM189 RNA, herein schematically represented by VGAM2 binds complimentarily to a host target binding site located in an untranslated region of VGAM189 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM189 host target RNA, herein schematically represented by VGAM2 HOST TARGET RNA into VGAM189 host target protein, herein schematically represented by VGAM2 HOST TARGET PROTEIN, both of FIG. 1.

It is appreciated that a function of VGR401 gene, herein designated VGR GENE, is inhibition of expression of host target genes, as part of a novel viral mechanism of attacking a host. Accordingly, utilities of VGR401 gene include diagnosis, prevention and treatment of viral infection by. Specific functions, and accordingly utilities, of VGR401 gene, herein designated VGR GENE, correlate with, and may be deduced from, the identity of the host target genes, which are inhibited by VGAM RNAs comprised in the operon-like cluster of VGR401 gene: VGAM188 host target protein and VGAM189 host target protein, herein schematically represented by VGAM1 HOST TARGET PROTEIN and VGAM HOST TARGET PROTEIN respectively. The function of these host target genes is elaborated hereinabove with reference to VGAM188 and VGAM189

FIG. 9 further provides a conceptual description of novel bioinformatically detected regulatory viral gene, referred to here as Viral Genomic Record 402(VGR402) viral gene, which encodes an operon-like cluster of novel viral micro RNA-like genes, each of which in turn modulates expression of at least one host target gene, the function and utility of which at least one host target gene is known in the art.

VGR402 gene, herein designated VGR GENE, is a novel bioinformatically detected regulatory, non protein coding, RNA viral gene. The method by which VGR402 gene was detected is described hereinabove with reference to FIGS. 6-15.

VGR402 gene encodes VGR402 precursor RNA, herein designated VGR PRECURSOR RNA, an RNA molecule, typically several hundred nucleotides long.

VGR402 precursor RNA folds spatially, forming VGR402 folded precursor RNA, herein designated VGR FOLDED PRECURSOR RNA. It is appreciated that VGR402 folded precursor RNA, herein designated VGR FOLDED PRECURSOR RNA, comprises a plurality of what is known in the art as hairpin structures. These hairpin structures are due to the fact that the nucleotide sequence of VGR402 precursor RNA comprises a plurality of segments, the first half of each such segment having a nucleotide sequence which is at least a partial inversed-reversed sequence of the second half thereof, as is well known in the art.

VGR402 folded precursor RNA, herein designated VGR FOLDED PRECURSOR RNA, is naturally processed by cellular enzymatic activity into at least 2 separate VGAM precursor RNAs, VGAM193 precursor RNA and VGAM194 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM193 RNA and VGAM194 RNA respectively, herein schematically represented by VGAM1 RNA and VGAM2 RNA respectively, each of which VGAM RNAs corresponding to VGAM RNA of FIG. 8.

VGAM193 RNA, herein schematically represented by VGAM1 binds complimentarily to a host target binding site located in an untranslated region of VGAM193 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM193 host target RNA, herein schematically represented by VGAM1 HOST TARGET RNA into VGAM193 host target protein, herein schematically represented by VGAM1 HOST TARGET PROTEIN, both of FIG. 1.

VGAM194 RNA, herein schematically represented by VGAM2 binds complimentarily to a host target binding site located in an untranslated region of VGAM194 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM194 host target RNA, herein schematically represented by VGAM2 HOST TARGET RNA into VGAM194 host target protein, herein schematically represented by VGAM2 HOST TARGET PROTEIN, both of FIG. 1.

It is appreciated that a function of VGR402 gene, herein designated VGR GENE, is inhibition of expression of host target genes, as part of a novel viral mechanism of attacking a host. Accordingly, utilities of VGR402 gene include diagnosis, prevention and treatment of viral infection by. Specific functions, and accordingly utilities, of VGR402 gene, herein designated VGR GENE, correlate with, and may be deduced from, the identity of the host target genes, which are inhibited by VGAM RNAs comprised in the operon-like cluster of VGR402 gene: VGAM193 host target protein and VGAM194 host target protein, herein schematically represented by VGAM1 HOST TARGET PROTEIN and VGAM HOST TARGET PROTEIN respectively. The function of these host target genes is elaborated hereinabove with reference to VGAM193 and VGAM194

FIG. 9 further provides a conceptual description of novel bioinformatically detected regulatory viral gene, referred to here as Viral Genomic Record 403(VGR403) viral gene, which encodes an operon-like cluster of novel viral micro RNA-like genes, each of which in turn modulates expression of at least one host target gene, the function and utility of which at least one host target gene is known in the art.

VGR403 gene, herein designated VGR GENE, is a novel bioinformatically detected regulatory, non protein coding, RNA viral gene. The method by which VGR403 gene was detected is described hereinabove with reference to FIGS. 6-15.

VGR403 gene encodes VGR403 precursor RNA, herein designated VGR PRECURSOR RNA, an RNA molecule, typically several hundred nucleotides long.

VGR403 precursor RNA folds spatially, forming VGR403 folded precursor RNA, herein designated VGR FOLDED PRECURSOR RNA. It is appreciated that VGR403 folded precursor RNA, herein designated VGR FOLDED PRECURSOR RNA, comprises a plurality of what is known in the art as hairpin structures. These hairpin structures are due to the fact that the nucleotide sequence of VGR403 precursor RNA comprises a plurality of segments, the first half of each such segment having a nucleotide sequence which is at least a partial inversed-reversed sequence of the second half thereof, as is well known in the art.

VGR403 folded precursor RNA, herein designated VGR FOLDED PRECURSOR RNA, is naturally processed by cellular enzymatic activity into at least 3 separate VGAM precursor RNAs, VGAM195 precursor RNA, VGAM196 precursor RNA and VGAM197 precursor RNA, herein schematically represented by VGAM1 PRECURSOR, VGAM2 PRECURSOR and VGAM3 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM195 RNA, VGAM196 RNA and VGAM197 RNA respectively, herein schematically represented by VGAM1 RNA, VGAM2 RNA and VGAM3 RNA respectively, each of which VGAM RNAs corresponding to VGAM RNA of FIG. 8.

VGAM195 RNA, herein schematically represented by VGAM1 binds complimentarily to a host target binding site located in an untranslated region of VGAM195 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM195 host target RNA, herein schematically represented by VGAM1 HOST TARGET RNA into VGAM195 host target protein, herein schematically represented by VGAM1 HOST TARGET PROTEIN, both of FIG. 1.

VGAM196 RNA, herein schematically represented by VGAM2 binds complimentarily to a host target binding site located in an untranslated region of VGAM196 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM196 host target RNA, herein schematically represented by VGAM2 HOST TARGET RNA into VGAM196 host target protein, herein schematically represented by VGAM2 HOST TARGET PROTEIN, both of FIG. 1.

VGAM197 RNA, herein schematically represented by VGAM3 binds complimentarily to a host target binding site located in an untranslated region of VGAM197 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM197 host target RNA, herein schematically represented by VGAM3 HOST TARGET RNA into VGAM197 host target protein, herein schematically represented by VGAM3 HOST TARGET PROTEIN, both of FIG. 1.

It is appreciated that a function of VGR403 gene, herein designated VGR GENE, is inhibition of expression of host target genes, as part of a novel viral mechanism of attacking a host. Accordingly, utilities of VGR403 gene include diagnosis, prevention and treatment of viral infection by. Specific functions, and accordingly utilities, of VGR403 gene, herein designated VGR GENE, correlate with, and may be deduced from, the identity of the host target genes, which are inhibited by VGAM RNAs comprised in the operon-like cluster of VGR403 gene: VGAM195 host target protein, VGAM196 host target protein and VGAM197 host target protein, herein schematically represented by VGAM1 HOST TARGET PROTEIN through VGAM HOST TARGET PROTEIN respectively. The function of these host target genes is elaborated hereinabove with reference to VGAM195, VGAM196 and VGAM197

FIG. 9 further provides a conceptual description of novel bioinformatically detected regulatory viral gene, referred to here as Viral Genomic Record 404(VGR404) viral gene, which encodes an operon-like cluster of novel viral micro RNA-like genes, each of which in turn modulates expression of at least one host target gene, the function and utility of which at least one host target gene is known in the art.

VGR404 gene, herein designated VGR GENE, is a novel bioinformatically detected regulatory, non protein coding, RNA viral gene. The method by which VGR404 gene was detected is described hereinabove with reference to FIGS. 6-15.

VGR404 gene encodes VGR404 precursor RNA, herein designated VGR PRECURSOR RNA, an RNA molecule, typically several hundred nucleotides long.

VGR404 precursor RNA folds spatially, forming VGR404 folded precursor RNA, herein designated VGR FOLDED PRECURSOR RNA. It is appreciated that VGR404 folded precursor RNA, herein designated VGR FOLDED PRECURSOR RNA, comprises a plurality of what is known in the art as hairpin structures. These hairpin structures are due to the fact that the nucleotide sequence of VGR404 precursor RNA comprises a plurality of segments, the first half of each such segment having a nucleotide sequence which is at least a partial inversed-reversed sequence of the second half thereof, as is well known in the art.

VGR404 folded precursor RNA, herein designated VGR FOLDED PRECURSOR RNA, is naturally processed by cellular enzymatic activity into at least 3 separate VGAM precursor RNAs, VGAM198 precursor RNA, VGAM199 precursor RNA and VGAM200 precursor RNA, herein schematically represented by VGAM1 PRECURSOR, VGAM2 PRECURSOR and VGAM3 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM198 RNA, VGAM199 RNA and VGAM200 RNA respectively, herein schematically represented by VGAM1 RNA, VGAM2 RNA and VGAM3 RNA respectively, each of which VGAM RNAs corresponding to VGAM RNA of FIG. 8.

VGAM198 RNA, herein schematically represented by VGAM1 binds complimentarily to a host target binding site located in an untranslated region of VGAM198 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM198 host target RNA, herein schematically represented by VGAM1 HOST TARGET RNA into VGAM198 host target protein, herein schematically represented by VGAM1 HOST TARGET PROTEIN, both of FIG. 1.

VGAM199 RNA, herein schematically represented by VGAM2 binds complimentarily to a host target binding site located in an untranslated region of VGAM199 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM199 host target RNA, herein schematically represented by VGAM2 HOST TARGET RNA into VGAM199 host target protein, herein schematically represented by VGAM2 HOST TARGET PROTEIN, both of FIG. 1.

VGAM200 RNA, herein schematically represented by VGAM3 binds complimentarily to a host target binding site located in an untranslated region of VGAM200 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM200 host target RNA, herein schematically represented by VGAM3 HOST TARGET RNA into VGAM200 host target protein, herein schematically represented by VGAM3 HOST TARGET PROTEIN, both of FIG. 1.

It is appreciated that a function of VGR404 gene, herein designated VGR GENE, is inhibition of expression of host target genes, as part of a novel viral mechanism of attacking a host. Accordingly, utilities of VGR404 gene include diagnosis, prevention and treatment of viral infection by. Specific functions, and accordingly utilities, of VGR404 gene, herein designated VGR GENE, correlate with, and may be deduced from, the identity of the host target genes, which are inhibited by VGAM RNAs comprised in the operon-like cluster of VGR404 gene: VGAM198 host target protein, VGAM199 host target protein and VGAM200 host target protein, herein schematically represented by VGAM1 HOST TARGET PROTEIN through VGAM HOST TARGET PROTEIN respectively. The function of these host target genes is elaborated hereinabove with reference to VGAM198, VGAM199 and VGAM200

FIG. 9 further provides a conceptual description of novel bioinformatically detected regulatory viral gene, referred to here as Viral Genomic Record 405(VGR405) viral gene, which encodes an operon-like cluster of novel viral micro RNA-like genes, each of which in turn modulates expression of at least one host target gene, the function and utility of which at least one host target gene is known in the art.

VGR405 gene, herein designated VGR GENE, is a novel bioinformatically detected regulatory, non protein coding, RNA viral gene. The method by which VGR405 gene was detected is described hereinabove with reference to FIGS. 6-15.

VGR405 gene encodes VGR405 precursor RNA, herein designated VGR PRECURSOR RNA, an RNA molecule, typically several hundred nucleotides long.

VGR405 precursor RNA folds spatially, forming VGR405 folded precursor RNA, herein designated VGR FOLDED PRECURSOR RNA. It is appreciated that VGR405 folded precursor RNA, herein designated VGR FOLDED PRECURSOR RNA, comprises a plurality of what is known in the art as hairpin structures. These hairpin structures are due to the fact that the nucleotide sequence of VGR405 precursor RNA comprises a plurality of segments, the first half of each such segment having a nucleotide sequence which is at least a partial inversed-reversed sequence of the second half thereof, as is well known in the art.

VGR405 folded precursor RNA, herein designated VGR FOLDED PRECURSOR RNA, is naturally processed by cellular enzymatic activity into at least 2 separate VGAM precursor RNAs, VGAM201 precursor RNA and VGAM202 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM201 RNA and VGAM202 RNA respectively, herein schematically represented by VGAM1 RNA and VGAM2 RNA respectively, each of which VGAM RNAs corresponding to VGAM RNA of FIG. 8.

VGAM201 RNA, herein schematically represented by VGAM1 binds complimentarily to a host target binding site located in an untranslated region of VGAM201 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM201 host target RNA, herein schematically represented by VGAM1 HOST TARGET RNA into VGAM201 host target protein, herein schematically represented by VGAM1 HOST TARGET PROTEIN, both of FIG. 1.

VGAM202 RNA, herein schematically represented by VGAM2 binds complimentarily to a host target binding site located in an untranslated region of VGAM202 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM202 host target RNA, herein schematically represented by VGAM2 HOST TARGET RNA into VGAM202 host target protein, herein schematically represented by VGAM2 HOST TARGET PROTEIN, both of FIG. 1.

It is appreciated that a function of VGR405 gene, herein designated VGR GENE, is inhibition of expression of host target genes, as part of a novel viral mechanism of attacking a host. Accordingly, utilities of VGR405 gene include diagnosis, prevention and treatment of viral infection by. Specific functions, and accordingly utilities, of VGR405 gene, herein designated VGR GENE, correlate with, and may be deduced from, the identity of the host target genes, which are inhibited by VGAM RNAs comprised in the operon-like cluster of VGR405 gene: VGAM201 host target protein and VGAM202 host target protein, herein schematically represented by VGAM1 HOST TARGET PROTEIN and VGAM HOST TARGET PROTEIN respectively. The function of these host target genes is elaborated hereinabove with reference to VGAM201 and VGAM202

FIG. 9 further provides a conceptual description of novel bioinformatically detected regulatory viral gene, referred to here as Viral Genomic Record 406(VGR406) viral gene, which encodes an operon-like cluster of novel viral micro RNA-like genes, each of which in turn modulates expression of at least one host target gene, the function and utility of which at least one host target gene is known in the art.

VGR406 gene, herein designated VGR GENE, is a novel bioinformatically detected regulatory, non protein coding, RNA viral gene. The method by which VGR406 gene was detected is described hereinabove with reference to FIGS. 6-15.

VGR406 gene encodes VGR406 precursor RNA, herein designated VGR PRECURSOR RNA, an RNA molecule, typically several hundred nucleotides long.

VGR406 precursor RNA folds spatially, forming VGR406 folded precursor RNA, herein designated VGR FOLDED PRECURSOR RNA. It is appreciated that VGR406 folded precursor RNA, herein designated VGR FOLDED PRECURSOR RNA, comprises a plurality of what is known in the art as hairpin structures. These hairpin structures are due to the fact that the nucleotide sequence of VGR406 precursor RNA comprises a plurality of segments, the first half of each such segment having a nucleotide sequence which is at least a partial inversed-reversed sequence of the second half thereof, as is well known in the art.

VGR406 folded precursor RNA, herein designated VGR FOLDED PRECURSOR RNA, is naturally processed by cellular enzymatic activity into at least 3 separate VGAM precursor RNAs, VGAM203 precursor RNA, VGAM204 precursor RNA and VGAM205 precursor RNA, herein schematically represented by VGAM1 PRECURSOR, VGAM2 PRECURSOR and VGAM3 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM203 RNA, VGAM204 RNA and VGAM205 RNA respectively, herein schematically represented by VGAM1 RNA, VGAM2 RNA and VGAM3 RNA respectively, each of which VGAM RNAs corresponding to VGAM RNA of FIG. 8.

VGAM203 RNA, herein schematically represented by VGAM1 binds complimentarily to a host target binding site located in an untranslated region of VGAM203 host target RNA, herein schematically represented by VGAM1 HOST TARGET RNA, which host target binding site corresponds to a host target binding site such as BINDING SITE I, BIND- ING SITE II or BINDING SITE III of FIG. 1, thereby inhibiting translation of VGAM203 host target RNA, herein schematically represented by VGAM1 HOST TARGET RNA into VGAM203 host target protein, herein schematically represented by VGAM1 HOST TARGET PROTEIN, both of FIG. 1.

VGAM204 RNA, herein schematically represented by VGAM2 binds complimentarily to a host target binding site located in an untranslated region of VGAM204 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM204 host target RNA, herein schematically represented by VGAM2 HOST TARGET RNA into VGAM204 host target protein, herein schematically represented by VGAM2 HOST TARGET PROTEIN, both of FIG. 1.

VGAM205 RNA, herein schematically represented by VGAM3 binds complimentarily to a host target binding site located in an untranslated region of VGAM205 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM205 host target RNA, herein schematically represented by VGAM3 HOST TARGET RNA into VGAM205 host target protein, herein schematically represented by VGAM3 HOST TARGET PROTEIN, both of FIG. 1.

It is appreciated that a function of VGR406 gene, herein designated VGR GENE, is inhibition of expression of host target genes, as part of a novel viral mechanism of attacking a host. Accordingly, utilities of VGR406 gene include diagnosis, prevention and treatment of viral infection by. Specific functions, and accordingly utilities, of VGR406 gene, herein designated VGR GENE, correlate with, and may be deduced from, the identity of the host target genes, which are inhibited by VGAM RNAs comprised in the operon-like cluster of VGR406 gene: VGAM203 host target protein, VGAM204 host target protein and VGAM205 host target protein, herein schematically represented by VGAM1 HOST TARGET PROTEIN through VGAM HOST TARGET PROTEIN respectively. The function of these host target genes is elaborated hereinabove with reference to VGAM203, VGAM204 and VGAM205

FIG. 9 further provides a conceptual description of novel bioinformatically detected regulatory viral gene, referred to here as Viral Genomic Record 407(VGR407) viral gene, which encodes an operon-like cluster of novel viral micro RNA-like genes, each of which in turn modulates expression of at least one host target gene, the function and utility of which at least one host target gene is known in the art.

VGR407 gene, herein designated VGR GENE, is a novel bioinformatically detected regulatory, non protein coding, RNA viral gene. The method by which VGR407 gene was detected is described hereinabove with reference to FIGS. 6-15.

VGR407 gene encodes VGR407 precursor RNA, herein designated VGR PRECURSOR RNA, an RNA molecule, typically several hundred nucleotides long.

VGR407 precursor RNA folds spatially, forming VGR407 folded precursor RNA, herein designated VGR FOLDED PRECURSOR RNA. It is appreciated that VGR407 folded precursor RNA, herein designated VGR FOLDED PRECURSOR RNA, comprises a plurality of what is known in the art as hairpin structures. These hairpin structures are due to the fact that the nucleotide sequence of VGR407 precursor RNA comprises a plurality of segments, the first half of each such segment having a nucleotide sequence which is at least a partial inversed-reversed sequence of the second half thereof, as is well known in the art.

VGR407 folded precursor RNA, herein designated VGR FOLDED PRECURSOR RNA, is naturally processed by cellular enzymatic activity into at least 4 separate VGAM precursor RNAs, VGAM206 precursor RNA, VGAM207 precursor RNA, VGAM208 precursor RNA and VGAM209 precursor RNA, herein schematically represented by VGAM1 PRECURSOR, VGAM2 PRECURSOR, VGAM3 PRECURSOR and VGAM4 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM206 RNA, VGAM207 RNA, VGAM208 RNA and VGAM209 RNA respectively, herein schematically represented by VGAM1 RNA, VGAM2 RNA, VGAM3 RNA and VGAM4 RNA respectively, each of which VGAM RNAs corresponding to VGAM RNA of FIG. 8.

VGAM206 RNA, herein schematically represented by VGAM1 binds complimentarily to a host target binding site located in an untranslated region of VGAM206 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM206 host target RNA, herein schematically represented by VGAM1 HOST TARGET RNA into VGAM206 host target protein, herein schematically represented by VGAM1 HOST TARGET PROTEIN, both of FIG. 1.

VGAM207 RNA, herein schematically represented by VGAM2 binds complimentarily to a host target binding site located in an untranslated region of VGAM207 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM207 host target RNA, herein schematically represented by VGAM2 HOST TARGET RNA into VGAM207 host target protein, herein schematically represented by VGAM2 HOST TARGET PROTEIN, both of FIG. 1.

VGAM208 RNA, herein schematically represented by VGAM3 binds complimentarily to a host target binding site located in an untranslated region of VGAM208 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM208 host target RNA, herein schematically represented by VGAM3 HOST TARGET RNA into VGAM208 host target protein, herein schematically represented by VGAM3 HOST TARGET PROTEIN, both of FIG. 1.

VGAM209 RNA, herein schematically represented by VGAM4 binds complimentarily to a host target binding site located in an untranslated region of VGAM209 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM209 host target RNA, herein schematically represented by VGAM4 HOST TARGET RNA into VGAM209 host target protein, herein schematically represented by VGAM4 HOST TARGET PROTEIN, both of FIG. 1.

It is appreciated that a function of VGR407 gene, herein designated VGR GENE, is inhibition of expression of host target genes, as part of a novel viral mechanism of attacking a host. Accordingly, utilities of VGR407 gene include diagnosis, prevention and treatment of viral infection by. Specific functions, and accordingly utilities, of VGR407 gene, herein designated VGR GENE, correlate with, and may be deduced from, the identity of the host target genes, which are inhibited by VGAM RNAs comprised in the operon-like cluster of VGR407 gene: VGAM206 host target protein, VGAM207 host target protein, VGAM208 host target protein and VGAM209 host target protein, herein schematically represented by VGAM1 HOST TARGET PROTEIN through VGAM HOST TARGET PROTEIN respectively. The function of these host target genes is elaborated hereinabove with reference to VGAM206, VGAM207, VGAM208 and VGAM209

FIG. 9 further provides a conceptual description of novel bioinformatically detected regulatory viral gene, referred to here as Viral Genomic Record 408(VGR408) viral gene, which encodes an operon-like cluster of novel viral micro RNA-like genes, each of which in turn modulates expression of at least one host target gene, the function and utility of which at least one host target gene is known in the art.

VGR408 gene, herein designated VGR GENE, is a novel bioinformatically detected regulatory, non protein coding, RNA viral gene. The method by which VGR408 gene was detected is described hereinabove with reference to FIGS. 6-15.

VGR408 gene encodes VGR408 precursor RNA, herein designated VGR PRECURSOR RNA, an RNA molecule, typically several hundred nucleotides long.

VGR408 precursor RNA folds spatially, forming VGR408 folded precursor RNA, herein designated VGR FOLDED PRECURSOR RNA. It is appreciated that VGR408 folded precursor RNA, herein designated VGR FOLDED PRECURSOR RNA, comprises a plurality of what is known in the art as hairpin structures. These hairpin structures are due to the fact that the nucleotide sequence of VGR408 precursor RNA comprises a plurality of segments, the first half of each such segment having a nucleotide sequence which is at least a partial inversed-reversed sequence of the second half thereof, as is well known in the art.

VGR408 folded precursor RNA, herein designated VGR FOLDED PRECURSOR RNA, is naturally processed by cellular enzymatic activity into at least 4 separate VGAM precursor RNAs, VGAM210 precursor RNA, VGAM211 precursor RNA, VGAM212 precursor RNA and VGAM213 precursor RNA, herein schematically represented by VGAM1 PRECURSOR, VGAM2 PRECURSOR, VGAM3 PRECURSOR and VGAM4 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM210 RNA, VGAM211 RNA, VGAM212 RNA and VGAM213 RNA respectively, herein schematically represented by VGAM1 RNA, VGAM2 RNA, VGAM3 RNA and VGAM4 RNA respectively, each of which VGAM RNAs corresponding to VGAM RNA of FIG. 8.

VGAM210 RNA, herein schematically represented by VGAM1 binds complimentarily to a host target binding site located in an untranslated region of VGAM210 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM210 host target RNA, herein schematically represented by VGAM1 HOST TARGET RNA into VGAM210 host target protein, herein schematically represented by VGAM1 HOST TARGET PROTEIN, both of FIG. 1.

VGAM211 RNA, herein schematically represented by VGAM2 binds complimentarily to a host target binding site located in an untranslated region of VGAM211 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM211 host target RNA, herein schematically represented by VGAM2 HOST TARGET RNA into VGAM211 host target protein, herein schematically represented by VGAM2 HOST TARGET PROTEIN, both of FIG. 1.

VGAM212 RNA, herein schematically represented by VGAM3 binds complimentarily to a host target binding site located in an untranslated region of VGAM212 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM212 host target RNA, herein schematically represented by VGAM3 HOST TARGET RNA into VGAM212 host target protein, herein schematically represented by VGAM3 HOST TARGET PROTEIN, both of FIG. 1.

VGAM213 RNA, herein schematically represented by VGAM4 binds complimentarily to a host target binding site located in an untranslated region of VGAM213 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM213 host target RNA, herein schematically represented by VGAM4 HOST TARGET RNA into VGAM213 host target protein, herein schematically represented by VGAM4 HOST TARGET PROTEIN, both of FIG. 1.

It is appreciated that a function of VGR408 gene, herein designated VGR GENE, is inhibition of expression of host target genes, as part of a novel viral mechanism of attacking a host. Accordingly, utilities of VGR408 gene include diagnosis, prevention and treatment of viral infection by. Specific functions, and accordingly utilities, of VGR408 gene, herein designated VGR GENE, correlate with, and may be deduced from, the identity of the host target genes, which are inhibited by VGAM RNAs comprised in the operon-like cluster of VGR408 gene: VGAM210 host target protein, VGAM211 host target protein, VGAM212 host target protein and VGAM213 host target protein, herein schematically represented by VGAM1 HOST TARGET PROTEIN through VGAM HOST TARGET PROTEIN respectively. The function of these host target genes is elaborated hereinabove with reference to VGAM210, VGAM211, VGAM212 and VGAM213

FIG. 9 further provides a conceptual description of novel bioinformatically detected regulatory viral gene, referred to here as Viral Genomic Record 409(VGR409) viral gene, which encodes an operon-like cluster of novel viral micro RNA-like genes, each of which in turn modulates expression of at least one host target gene, the function and utility of which at least one host target gene is known in the art.

VGR409 gene, herein designated VGR GENE, is a novel bioinformatically detected regulatory, non protein coding, RNA viral gene. The method by which VGR409 gene was detected is described hereinabove with reference to FIGS. 6-15.

VGR409 gene encodes VGR409 precursor RNA, herein designated VGR PRECURSOR RNA, an RNA molecule, typically several hundred nucleotides long.

VGR409 precursor RNA folds spatially, forming VGR409 folded precursor RNA, herein designated VGR FOLDED PRECURSOR RNA. It is appreciated that VGR409 folded precursor RNA, herein designated VGR FOLDED PRECURSOR RNA, comprises a plurality of what is known in the art as hairpin structures. These hairpin structures are due to the fact that the nucleotide sequence of VGR409 precursor RNA comprises a plurality of segments, the first half of each such segment having a nucleotide sequence which is at least a partial inversed-reversed sequence of the second half thereof, as is well known in the art.

VGR409 folded precursor RNA, herein designated VGR FOLDED PRECURSOR RNA, is naturally processed by cellular enzymatic activity into at least 4 separate VGAM precursor RNAs, VGAM214 precursor RNA, VGAM215 precursor RNA, VGAM216 precursor RNA and VGAM217 precursor RNA, herein schematically represented by VGAM1 PRECURSOR, VGAM2 PRECURSOR, VGAM3 PRECURSOR and VGAM4 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM214 RNA, VGAM215 RNA, VGAM216 RNA and VGAM217 RNA respectively, herein schematically represented by VGAM1 RNA, VGAM2 RNA, VGAM3 RNA and VGAM4 RNA respectively, each of which VGAM RNAs corresponding to VGAM RNA of FIG. 8.

VGAM214 RNA, herein schematically represented by VGAM1 binds complimentarily to a host target binding site located in an untranslated region of VGAM214 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM214 host target RNA, herein schematically represented by VGAM1 HOST TARGET RNA into VGAM214 host target protein, herein schematically represented by VGAM1 HOST TARGET PROTEIN, both of FIG. 1.

VGAM215 RNA, herein schematically represented by VGAM2 binds complimentarily to a host target binding site located in an untranslated region of VGAM215 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM215 host target RNA, herein schematically represented by VGAM2 HOST TARGET RNA into VGAM215 host target protein, herein schematically represented by VGAM2 HOST TARGET PROTEIN, both of FIG. 1.

VGAM216 RNA, herein schematically represented by VGAM3 binds complimentarily to a host target binding site located in an untranslated region of VGAM216 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM216 host target RNA, herein schematically represented by VGAM3 HOST TARGET RNA into VGAM216 host target protein, herein schematically represented by VGAM3 HOST TARGET PROTEIN, both of FIG. 1.

VGAM217 RNA, herein schematically represented by VGAM4 binds complimentarily to a host target binding site located in an untranslated region of VGAM217 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM217 host target RNA, herein schematically represented by VGAM4 HOST TARGET RNA into VGAM217 host target protein, herein schematically represented by VGAM4 HOST TARGET PROTEIN, both of FIG. 1.

It is appreciated that a function of VGR409 gene, herein designated VGR GENE, is inhibition of expression of host target genes, as part of a novel viral mechanism of attacking a host. Accordingly, utilities of VGR409 gene include diagnosis, prevention and treatment of viral infection by. Specific functions, and accordingly utilities, of VGR409 gene, herein designated VGR GENE, correlate with, and may be deduced from, the identity of the host target genes, which are inhibited by VGAM RNAs comprised in the operon-like cluster of VGR409 gene: VGAM214 host target protein, VGAM215 host target protein, VGAM216 host target protein and VGAM217 host target protein, herein schematically represented by VGAM1 HOST TARGET PROTEIN through VGAM HOST TARGET PROTEIN respectively. The function of these host target genes is elaborated hereinabove with reference to VGAM214, VGAM215, VGAM216 and VGAM217

FIG. 9 further provides a conceptual description of novel bioinformatically detected regulatory viral gene, referred to here as Viral Genomic Record 410(VGR410) viral gene, which encodes an operon-like cluster of novel viral micro RNA-like genes, each of which in turn modulates expression of at least one host target gene, the function and utility of which at least one host target gene is known in the art.

VGR410 gene, herein designated VGR GENE, is a novel bioinformatically detected regulatory, non protein coding, RNA viral gene. The method by which VGR410 gene was detected is described hereinabove with reference to FIGS. 6-15.

VGR410 gene encodes VGR410 precursor RNA, herein designated VGR PRECURSOR RNA, an RNA molecule, typically several hundred nucleotides long.

VGR410 precursor RNA folds spatially, forming VGR410 folded precursor RNA, herein designated VGR FOLDED PRECURSOR RNA. It is appreciated that VGR410 folded precursor RNA, herein designated VGR FOLDED PRECURSOR RNA, comprises a plurality of what is known in the art as hairpin structures. These hairpin structures are due to the fact that the nucleotide sequence of VGR410 precursor RNA comprises a plurality of segments, the first half of each such segment having a nucleotide sequence which is at least a partial inversed-reversed sequence of the second half thereof, as is well known in the art.

VGR410 folded precursor RNA, herein designated VGR FOLDED PRECURSOR RNA, is naturally processed by cellular enzymatic activity into at least 3 separate VGAM precursor RNAs, VGAM219 precursor RNA, VGAM220 precursor RNA and VGAM221 precursor RNA, herein schematically represented by VGAM1 PRECURSOR, VGAM2 PRECURSOR and VGAM3 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM219 RNA, VGAM220 RNA and VGAM221 RNA respectively, herein schematically represented by VGAM1 RNA, VGAM2 RNA and VGAM3 RNA respectively, each of which VGAM RNAs corresponding to VGAM RNA of FIG. 8.

VGAM219 RNA, herein schematically represented by VGAM1 binds complimentarily to a host target binding site located in an untranslated region of VGAM219 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM219 host target RNA, herein schematically represented by VGAM1 HOST TARGET RNA into VGAM219 host target protein, herein schematically represented by VGAM1 HOST TARGET PROTEIN, both of FIG. 1.

VGAM220 RNA, herein schematically represented by VGAM2 binds complimentarily to a host target binding site located in an untranslated region of VGAM220 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM220 host target RNA, herein schematically represented by VGAM2 HOST TARGET RNA into VGAM220 host target protein, herein schematically represented by VGAM2 HOST TARGET PROTEIN, both of FIG. 1.

VGAM221 RNA, herein schematically represented by VGAM3 binds complimentarily to a host target binding site located in an untranslated region of VGAM221 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM221 host target RNA, herein schematically represented by VGAM3 HOST TARGET RNA into VGAM221 host target protein, herein schematically represented by VGAM3 HOST TARGET PROTEIN, both of FIG. 1.

It is appreciated that a function of VGR410 gene, herein designated VGR GENE, is inhibition of expression of host target genes, as part of a novel viral mechanism of attacking a host. Accordingly, utilities of VGR410 gene include diagnosis, prevention and treatment of viral infection by. Specific functions, and accordingly utilities, of VGR410 gene, herein designated VGR GENE, correlate with, and may be deduced from, the identity of the host target genes, which are inhibited by VGAM RNAs comprised in the operon-like cluster of VGR410 gene: VGAM219 host target protein, VGAM220 host target protein and VGAM221 host target protein, herein schematically represented by VGAM1 HOST TARGET PROTEIN through VGAM HOST TARGET PROTEIN respectively. The function of these host target genes is elaborated hereinabove with reference to VGAM219, VGAM220 and VGAM221

FIG. 9 further provides a conceptual description of novel bioinformatically detected regulatory viral gene, referred to here as Viral Genomic Record 411(VGR411) viral gene, which encodes an operon-like cluster of novel viral micro RNA-like genes, each of which in turn modulates expression of at least one host target gene, the function and utility of which at least one host target gene is known in the art.

VGR411 gene, herein designated VGR GENE, is a novel bioinformatically detected regulatory, non protein coding, RNA viral gene. The method by which VGR411 gene was detected is described hereinabove with reference to FIGS. 6-15.

VGR411 gene encodes VGR411 precursor RNA, herein designated VGR PRECURSOR RNA, an RNA molecule, typically several hundred nucleotides long.

VGR411 precursor RNA folds spatially, forming VGR411 folded precursor RNA, herein designated VGR FOLDED PRECURSOR RNA. It is appreciated that VGR411 folded precursor RNA, herein designated VGR FOLDED PRECURSOR RNA, comprises a plurality of what is known in the art as hairpin structures. These hairpin structures are due to the fact that the nucleotide sequence of VGR411 precursor RNA comprises a plurality of segments, the first half of each such segment having a nucleotide sequence which is at least a partial inversed-reversed sequence of the second half thereof, as is well known in the art.

VGR411 folded precursor RNA, herein designated VGR FOLDED PRECURSOR RNA, is naturally processed by cellular enzymatic activity into at least 2 separate VGAM precursor RNAs, VGAM222 precursor RNA and VGAM223 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM222 RNA and VGAM223 RNA respectively, herein schematically represented by VGAM1 RNA and VGAM2 RNA respectively, each of which VGAM RNAs corresponding to VGAM RNA of FIG. 8.

VGAM222 RNA, herein schematically represented by VGAM1 binds complimentarily to a host target binding site located in an untranslated region of VGAM222 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM222 host target RNA, herein schematically represented by VGAM1 HOST TARGET RNA into VGAM222 host target protein, herein schematically represented by VGAM1 HOST TARGET PROTEIN, both of FIG. 1.

VGAM223 RNA, herein schematically represented by VGAM2 binds complimentarily to a host target binding site located in an untranslated region of VGAM223 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM223 host target RNA, herein schematically represented by VGAM2 HOST TARGET RNA into VGAM223 host target protein, herein schematically represented by VGAM2 HOST TARGET PROTEIN, both of FIG. 1.

It is appreciated that a function of VGR411 gene, herein designated VGR GENE, is inhibition of expression of host target genes, as part of a novel viral mechanism of attacking a host. Accordingly, utilities of VGR411 gene include diagnosis, prevention and treatment of viral infection by. Specific functions, and accordingly utilities, of VGR411 gene, herein designated VGR GENE, correlate with, and may be deduced from, the identity of the host target genes, which are inhibited by VGAM RNAs comprised in the operon-like cluster of VGR411 gene: VGAM222 host target protein and VGAM223 host target protein, herein schematically represented by VGAM1 HOST TARGET PROTEIN and VGAM HOST TARGET PROTEIN respectively. The function of these host target genes is elaborated hereinabove with reference to VGAM222 and VGAM223

FIG. 9 further provides a conceptual description of novel bioinformatically detected regulatory viral gene, referred to here as Viral Genomic Record 412(VGR412) viral gene, which encodes an operon-like cluster of novel viral micro RNA-like genes, each of which in turn modulates expression of at least one host target gene, the function and utility of which at least one host target gene is known in the art.

VGR412 gene, herein designated VGR GENE, is a novel bioinformatically detected regulatory, non protein coding, RNA viral gene. The method by which VGR412 gene was detected is described hereinabove with reference to FIGS. 6-15.

VGR412 gene encodes VGR412 precursor RNA, herein designated VGR PRECURSOR RNA, an RNA molecule, typically several hundred nucleotides long.

VGR412 precursor RNA folds spatially, forming VGR412 folded precursor RNA, herein designated VGR FOLDED PRECURSOR RNA. It is appreciated that VGR412 folded precursor RNA, herein designated VGR FOLDED PRECURSOR RNA, comprises a plurality of what is known in the art as hairpin structures. These hairpin structures are due to the fact that the nucleotide sequence of VGR412 precursor RNA comprises a plurality of segments, the first half of each such segment having a nucleotide sequence which is at least a partial inversed-reversed sequence of the second half thereof, as is well known in the art.

VGR412 folded precursor RNA, herein designated VGR FOLDED PRECURSOR RNA, is naturally processed by cellular enzymatic activity into at least 4 separate VGAM precursor RNAs, VGAM224 precursor RNA, VGAM225 precursor RNA, VGAM226 precursor RNA and VGAM227 precursor RNA, herein schematically represented by VGAM1 PRECURSOR, VGAM2 PRECURSOR, VGAM3 PRECURSOR and VGAM4 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM224 RNA, VGAM225 RNA, VGAM226 RNA and VGAM227 RNA respectively, herein schematically represented by VGAM1 RNA, VGAM2 RNA, VGAM3 RNA and VGAM4 RNA respectively, each of which VGAM RNAs corresponding to VGAM RNA of FIG. 8.

VGAM224 RNA, herein schematically represented by VGAM1 binds complimentarily to a host target binding site located in an untranslated region of VGAM224 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM224 host target RNA, herein schematically represented by VGAM1 HOST TARGET RNA into VGAM224 host target protein, herein schematically represented by VGAM1 HOST TARGET PROTEIN, both of FIG. 1.

VGAM225 RNA, herein schematically represented by VGAM2 binds complimentarily to a host target binding site located in an untranslated region of VGAM225 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM225 host target RNA, herein schematically represented by VGAM2 HOST TARGET RNA into VGAM225 host target protein, herein schematically represented by VGAM2 HOST TARGET PROTEIN, both of FIG. 1.

VGAM226 RNA, herein schematically represented by VGAM3 binds complimentarily to a host target binding site located in an untranslated region of VGAM226 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM226 host target RNA, herein schematically represented by VGAM3 HOST TARGET RNA into VGAM226 host target protein, herein schematically represented by VGAM3 HOST TARGET PROTEIN, both of FIG. 1.

VGAM227 RNA, herein schematically represented by VGAM4 binds complimentarily to a host target binding site located in an untranslated region of VGAM227 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM227 host target RNA, herein schematically represented by VGAM4 HOST TARGET RNA into VGAM227 host target protein, herein schematically represented by VGAM4 HOST TARGET PROTEIN, both of FIG. 1.

It is appreciated that a function of VGR412 gene, herein designated VGR GENE, is inhibition of expression of host target genes, as part of a novel viral mechanism of attacking a host. Accordingly, utilities of VGR412 gene include diagnosis, prevention and treatment of viral infection by. Specific functions, and accordingly utilities, of VGR412 gene, herein designated VGR GENE, correlate with, and may be deduced from, the identity of the host target genes, which are inhibited by VGAM RNAs comprised in the operon-like cluster of VGR412 gene: VGAM224 host target protein, VGAM225 host target protein, VGAM226 host target protein and VGAM227 host target protein, herein schematically represented by VGAM1 HOST TARGET PROTEIN through VGAM HOST TARGET PROTEIN respectively. The function of these host target genes is elaborated hereinabove with reference to VGAM224, VGAM225, VGAM226 and VGAM227

FIG. 9 further provides a conceptual description of novel bioinformatically detected regulatory viral gene, referred to here as Viral Genomic Record 413(VGR413) viral gene, which encodes an operon-like cluster of novel viral micro RNA-like genes, each of which in turn modulates expression of at least one host target gene, the function and utility of which at least one host target gene is known in the art.

VGR413 gene, herein designated VGR GENE, is a novel bioinformatically detected regulatory, non protein coding, RNA viral gene. The method by which VGR413 gene was detected is described hereinabove with reference to FIGS. 6-15.

VGR413 gene encodes VGR413 precursor RNA, herein designated VGR PRECURSOR RNA, an RNA molecule, typically several hundred nucleotides long.

VGR413 precursor RNA folds spatially, forming VGR413 folded precursor RNA, herein designated VGR FOLDED PRECURSOR RNA. It is appreciated that VGR413 folded precursor RNA, herein designated VGR FOLDED PRECURSOR RNA, comprises a plurality of what is known in the art as hairpin structures. These hairpin structures are due to the fact that the nucleotide sequence of VGR413 precursor RNA comprises a plurality of segments, the first half of each such segment having a nucleotide sequence which is at least a partial inversed-reversed sequence of the second half thereof, as is well known in the art.

VGR413 folded precursor RNA, herein designated VGR FOLDED PRECURSOR RNA, is naturally processed by cellular enzymatic activity into at least 4 separate VGAM precursor RNAs, VGAM230 precursor RNA, VGAM231 precursor RNA, VGAM232 precursor RNA and VGAM233 precursor RNA, herein schematically represented by VGAM1 PRECURSOR, VGAM2 PRECURSOR, VGAM3 PRECURSOR and VGAM4 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM230 RNA, VGAM231 RNA, VGAM232 RNA and VGAM233 RNA respectively, herein schematically represented by VGAM1 RNA, VGAM2 RNA, VGAM3 RNA and VGAM4 RNA respectively, each of which VGAM RNAs corresponding to VGAM RNA of FIG. 8.

VGAM230 RNA, herein schematically represented by VGAM1 binds complimentarily to a host target binding site located in an untranslated region of VGAM230 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM230 host target RNA, herein schematically represented by VGAM1 HOST TARGET RNA into VGAM230 host target protein, herein schematically represented by VGAM1 HOST TARGET PROTEIN, both of FIG. 1.

VGAM231 RNA, herein schematically represented by VGAM2 binds complimentarily to a host target binding site located in an untranslated region of VGAM231 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM231 host target RNA, herein schematically represented by VGAM2 HOST TARGET RNA into VGAM231 host target protein, herein schematically represented by VGAM2 HOST TARGET PROTEIN, both of FIG. 1.

VGAM232 RNA, herein schematically represented by VGAM3 binds complimentarily to a host target binding site located in an untranslated region of VGAM232 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM232 host target RNA, herein schematically represented by VGAM3 HOST TARGET RNA into VGAM232 host target protein, herein schematically represented by VGAM3 HOST TARGET PROTEIN, both of FIG. 1.

VGAM233 RNA, herein schematically represented by VGAM4 binds complimentarily to a host target binding site located in an untranslated region of VGAM233 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM233 host target RNA, herein schematically represented by VGAM4 HOST TARGET RNA into VGAM233 host target protein, herein schematically represented by VGAM4 HOST TARGET PROTEIN, both of FIG. 1.

It is appreciated that a function of VGR413 gene, herein designated VGR GENE, is inhibition of expression of host target genes, as part of a novel viral mechanism of attacking a host. Accordingly, utilities of VGR413 gene include diagnosis, prevention and treatment of viral infection by. Specific functions, and accordingly utilities, of VGR413 gene, herein designated VGR GENE, correlate with, and may be deduced from, the identity of the host target genes, which are inhibited by VGAM RNAs comprised in the operon-like cluster of VGR413 gene: VGAM230 host target protein, VGAM231 host target protein, VGAM232 host target protein and VGAM233 host target protein, herein schematically represented by VGAM1 HOST TARGET PROTEIN through VGAM HOST TARGET PROTEIN respectively. The function of these host target genes is elaborated hereinabove with reference to VGAM230, VGAM231, VGAM232 and VGAM233

FIG. 9 further provides a conceptual description of novel bioinformatically detected regulatory viral gene, referred to here as Viral Genomic Record 414(VGR414) viral gene, which encodes an operon-like cluster of novel viral micro RNA-like genes, each of which in turn modulates expression of at least one host target gene, the function and utility of which at least one host target gene is known in the art.

VGR414 gene, herein designated VGR GENE, is a novel bioinformatically detected regulatory, non protein coding, RNA viral gene. The method by which VGR414 gene was detected is described hereinabove with reference to FIGS. 6-15.

VGR414 gene encodes VGR414 precursor RNA, herein designated VGR PRECURSOR RNA, an RNA molecule, typically several hundred nucleotides long.

VGR414 precursor RNA folds spatially, forming VGR414 folded precursor RNA, herein designated VGR FOLDED PRECURSOR RNA. It is appreciated that VGR414 folded precursor RNA, herein designated VGR FOLDED PRECURSOR RNA, comprises a plurality of what is known in the art as hairpin structures. These hairpin structures are due to the fact that the nucleotide sequence of VGR414 precursor RNA comprises a plurality of segments, the first half of each such segment having a nucleotide sequence which is at least a partial inversed-reversed sequence of the second half thereof, as is well known in the art.

VGR414 folded precursor RNA, herein designated VGR FOLDED PRECURSOR RNA, is naturally processed by cellular enzymatic activity into at least 2 separate VGAM precursor RNAs, VGAM234 precursor RNA and VGAM235 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM234 RNA and VGAM235 RNA respectively, herein schematically represented by VGAM1 RNA and VGAM2 RNA respectively, each of which VGAM RNAs corresponding to VGAM RNA of FIG. 8.

VGAM234 RNA, herein schematically represented by VGAM1 binds complimentarily to a host target binding site located in an untranslated region of VGAM234 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM234 host target RNA, herein schematically represented by VGAM1 HOST TARGET RNA into VGAM234 host target protein, herein schematically represented by VGAM1 HOST TARGET PROTEIN, both of FIG. 1.

VGAM235 RNA, herein schematically represented by VGAM2 binds complimentarily to a host target binding site located in an untranslated region of VGAM235 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM235 host target RNA, herein schematically represented by VGAM2 HOST TARGET RNA into VGAM235 host target protein, herein schematically represented by VGAM2 HOST TARGET PROTEIN, both of FIG. 1.

It is appreciated that a function of VGR414 gene, herein designated VGR GENE, is inhibition of expression of host target genes, as part of a novel viral mechanism of attacking a host. Accordingly, utilities of VGR414 gene include diagnosis, prevention and treatment of viral infection by. Specific functions, and accordingly utilities, of VGR414 gene, herein designated VGR GENE, correlate with, and may be deduced from, the identity of the host target genes, which are inhibited by VGAM RNAs comprised in the operon-like cluster of VGR414 gene: VGAM234 host target protein and VGAM235 host target protein, herein schematically represented by VGAM1 HOST TARGET PROTEIN and VGAM HOST TARGET PROTEIN respectively. The function of these host target genes is elaborated hereinabove with reference to VGAM234 and VGAM235

FIG. 9 further provides a conceptual description of novel bioinformatically detected regulatory viral gene, referred to here as Viral Genomic Record 415(VGR415) viral gene, which encodes an operon-like cluster of novel viral micro RNA-like genes, each of which in turn modulates expression of at least one host target gene, the function and utility of which at least one host target gene is known in the art.

VGR415 gene, herein designated VGR GENE, is a novel bioinformatically detected regulatory, non protein coding, RNA viral gene. The method by which VGR415 gene was detected is described hereinabove with reference to FIGS. 6-15.

VGR415 gene encodes VGR415 precursor RNA, herein designated VGR PRECURSOR RNA, an RNA molecule, typically several hundred nucleotides long.

VGR415 precursor RNA folds spatially, forming VGR415 folded precursor RNA, herein designated VGR FOLDED PRECURSOR RNA. It is appreciated that VGR415 folded precursor RNA, herein designated VGR FOLDED PRECURSOR RNA, comprises a plurality of what is known in the art as hairpin structures. These hairpin structures are due to the fact that the nucleotide sequence of VGR415 precursor RNA comprises a plurality of segments, the first half of each such segment having a nucleotide sequence which is at least a partial inversed-reversed sequence of the second half thereof, as is well known in the art.

VGR415 folded precursor RNA, herein designated VGR FOLDED PRECURSOR RNA, is naturally processed by cellular enzymatic activity into at least 2 separate VGAM precursor RNAs, VGAM237 precursor RNA and VGAM238 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM237 RNA and VGAM238 RNA respectively, herein schematically represented by VGAM1 RNA and VGAM2 RNA respectively, each of which VGAM RNAs corresponding to VGAM RNA of FIG. 8.

VGAM237 RNA, herein schematically represented by VGAM1 binds complimentarily to a host target binding site located in an untranslated region of VGAM237 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM237 host target RNA, herein schematically represented by VGAM1 HOST TARGET RNA into VGAM237 host target protein, herein schematically represented by VGAM1 HOST TARGET PROTEIN, both of FIG. 1.

VGAM238 RNA, herein schematically represented by VGAM2 binds complimentarily to a host target binding site located in an untranslated region of VGAM238 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM238 host target RNA, herein schematically represented by VGAM2 HOST TARGET RNA into VGAM238 host target protein, herein schematically represented by VGAM2 HOST TARGET PROTEIN, both of FIG. 1.

It is appreciated that a function of VGR415 gene, herein designated VGR GENE, is inhibition of expression of host target genes, as part of a novel viral mechanism of attacking a host. Accordingly, utilities of VGR415 gene include diagnosis, prevention and treatment of viral infection by. Specific functions, and accordingly utilities, of VGR415 gene, herein designated VGR GENE, correlate with, and may be deduced from, the identity of the host target genes, which are inhibited by VGAM RNAs comprised in the operon-like cluster of VGR415 gene: VGAM237 host target protein and VGAM238 host target protein, herein schematically represented by VGAM1 HOST TARGET PROTEIN and VGAM HOST TARGET PROTEIN respectively. The function of these host target genes is elaborated hereinabove with reference to VGAM237 and VGAM238

FIG. 9 further provides a conceptual description of novel bioinformatically detected regulatory viral gene, referred to here as Viral Genomic Record 416(VGR416) viral gene, which encodes an operon-like cluster of novel viral micro RNA-like genes, each of which in turn modulates expression of at least one host target gene, the function and utility of which at least one host target gene is known in the art.

VGR416 gene, herein designated VGR GENE, is a novel bioinformatically detected regulatory, non protein coding, RNA viral gene. The method by which VGR416 gene was detected is described hereinabove with reference to FIGS. 6-15.

VGR416 gene encodes VGR416 precursor RNA, herein designated VGR PRECURSOR RNA, an RNA molecule, typically several hundred nucleotides long.

VGR416 precursor RNA folds spatially, forming VGR416 folded precursor RNA, herein designated VGR FOLDED PRECURSOR RNA. It is appreciated that VGR416 folded precursor RNA, herein designated VGR FOLDED PRECURSOR RNA, comprises a plurality of what is known in the art as hairpin structures. These hairpin structures are due to the fact that the nucleotide sequence of VGR416 precursor RNA comprises a plurality of segments, the first half of each such segment having a nucleotide sequence which is at least a partial inversed-reversed sequence of the second half thereof, as is well known in the art.

VGR416 folded precursor RNA, herein designated VGR FOLDED PRECURSOR RNA, is naturally processed by cellular enzymatic activity into at least 2 separate VGAM precursor RNAs, VGAM240 precursor RNA and VGAM241 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM240 RNA and VGAM241 RNA respectively, herein schematically represented by VGAM1 RNA and VGAM2 RNA respectively, each of which VGAM RNAs corresponding to VGAM RNA of FIG. 8.

VGAM240 RNA, herein schematically represented by VGAM1 binds complimentarily to a host target binding site located in an untranslated region of VGAM240 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM240 host target RNA, herein schematically represented by VGAM1 HOST TARGET RNA into VGAM240 host target protein, herein schematically represented by VGAM1 HOST TARGET PROTEIN, both of FIG. 1.

VGAM241 RNA, herein schematically represented by VGAM2 binds complimentarily to a host target binding site located in an untranslated region of VGAM241 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM241 host target RNA, herein schematically represented by VGAM2 HOST TARGET RNA into VGAM241 host target protein, herein schematically represented by VGAM2 HOST TARGET PROTEIN, both of FIG. 1.

It is appreciated that a function of VGR416 gene, herein designated VGR GENE, is inhibition of expression of host target genes, as part of a novel viral mechanism of attacking a host. Accordingly, utilities of VGR416 gene include diagnosis, prevention and treatment of viral infection by. Specific functions, and accordingly utilities, of VGR416 gene, herein designated VGR GENE, correlate with, and may be deduced from, the identity of the host target genes, which are inhibited by VGAM RNAs comprised in the operon-like cluster of VGR416 gene: VGAM240 host target protein and VGAM241 host target protein, herein schematically represented by VGAM1 HOST TARGET PROTEIN and VGAM HOST TARGET PROTEIN respectively. The function of these host target genes is elaborated hereinabove with reference to VGAM240 and VGAM241

FIG. 9 further provides a conceptual description of novel bioinformatically detected regulatory viral gene, referred to here as Viral Genomic Record 417(VGR417) viral gene, which encodes an operon-like cluster of novel viral micro RNA-like genes, each of which in turn modulates expression of at least one host target gene, the function and utility of which at least one host target gene is known in the art.

VGR417 gene, herein designated VGR GENE, is a novel bioinformatically detected regulatory, non protein coding, RNA viral gene. The method by which VGR417 gene was detected is described hereinabove with reference to FIGS. 6-15.

VGR417 gene encodes VGR417 precursor RNA, herein designated VGR PRECURSOR RNA, an RNA molecule, typically several hundred nucleotides long.

VGR417 precursor RNA folds spatially, forming VGR417 folded precursor RNA, herein designated VGR FOLDED PRECURSOR RNA. It is appreciated that VGR417 folded precursor RNA, herein designated VGR FOLDED PRECURSOR RNA, comprises a plurality of what is known in the art as hairpin structures. These hairpin structures are due to the fact that the nucleotide sequence of VGR417 precursor RNA comprises a plurality of segments, the first half of each such segment having a nucleotide sequence which is at least a partial inversed-reversed sequence of the second half thereof, as is well known in the art.

VGR417 folded precursor RNA, herein designated VGR FOLDED PRECURSOR RNA, is naturally processed by cellular enzymatic activity into at least 4 separate VGAM precursor RNAs, VGAM243 precursor RNA, VGAM244 precursor RNA, VGAM245 precursor RNA and VGAM246 precursor RNA, herein schematically represented by VGAM1 PRECURSOR, VGAM2 PRECURSOR, VGAM3 PRECURSOR and VGAM4 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM243 RNA, VGAM244 RNA, VGAM245 RNA and VGAM246 RNA respectively, herein schematically represented by VGAM1 RNA, VGAM2 RNA, VGAM3 RNA and VGAM4 RNA respectively, each of which VGAM RNAs corresponding to VGAM RNA of FIG. 8.

VGAM243 RNA, herein schematically represented by VGAM1 binds complimentarily to a host target binding site located in an untranslated region of VGAM243 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM243 host target RNA, herein schematically represented by VGAM1 HOST TARGET RNA into VGAM243 host target protein, herein schematically represented by VGAM1 HOST TARGET PROTEIN, both of FIG. 1.

VGAM244 RNA, herein schematically represented by VGAM2 binds complimentarily to a host target binding site located in an untranslated region of VGAM244 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM244 host target RNA, herein schematically represented by VGAM2 HOST TARGET RNA into VGAM244 host target protein, herein schematically represented by VGAM2 HOST TARGET PROTEIN, both of FIG. 1.

VGAM245 RNA, herein schematically represented by VGAM3 binds complimentarily to a host target binding site located in an untranslated region of VGAM245 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM245 host target RNA, herein schematically represented by VGAM3 HOST TARGET RNA into VGAM245 host target protein, herein schematically represented by VGAM3 HOST TARGET PROTEIN, both of FIG. 1.

VGAM246 RNA, herein schematically represented by VGAM4 binds complimentarily to a host target binding site located in an untranslated region of VGAM246 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM246 host target RNA, herein schematically represented by VGAM4 HOST TARGET RNA into VGAM246 host target protein, herein schematically represented by VGAM4 HOST TARGET PROTEIN, both of FIG. 1.

It is appreciated that a function of VGR417 gene, herein designated VGR GENE, is inhibition of expression of host target genes, as part of a novel viral mechanism of attacking a host. Accordingly, utilities of VGR417 gene include diagnosis, prevention and treatment of viral infection by. Specific functions, and accordingly utilities, of VGR417 gene, herein designated VGR GENE, correlate with, and may be deduced from, the identity of the host target genes, which are inhibited by VGAM RNAs comprised in the operon-like cluster of VGR417 gene: VGAM243 host target protein, VGAM244 host target protein, VGAM245 host target protein and VGAM246 host target protein, herein schematically represented by VGAM1 HOST TARGET PROTEIN through VGAM HOST TARGET PROTEIN respectively. The function of these host target genes is elaborated hereinabove with reference to VGAM243, VGAM244, VGAM245 and VGAM246

FIG. 9 further provides a conceptual description of novel bioinformatically detected regulatory viral gene, referred to here as Viral Genomic Record 418(VGR418) viral gene, which encodes an operon-like cluster of novel viral micro RNA-like genes, each of which in turn modulates expression of at least one host target gene, the function and utility of which at least one host target gene is known in the art.

VGR418 gene, herein designated VGR GENE, is a novel bioinformatically detected regulatory, non protein coding, RNA viral gene. The method by which VGR418 gene was detected is described hereinabove with reference to FIGS. 6-15.

VGR418 gene encodes VGR418 precursor RNA, herein designated VGR PRECURSOR RNA, an RNA molecule, typically several hundred nucleotides long.

VGR418 precursor RNA folds spatially, forming VGR418 folded precursor RNA, herein designated VGR FOLDED PRECURSOR RNA. It is appreciated that VGR418 folded precursor RNA, herein designated VGR FOLDED PRECURSOR RNA, comprises a plurality of what is known in the art as hairpin structures. These hairpin structures are due to the fact that the nucleotide sequence of VGR418 precursor RNA comprises a plurality of segments, the first half of each such segment having a nucleotide sequence which is at least a partial inversed-reversed sequence of the second half thereof, as is well known in the art.

VGR418 folded precursor RNA, herein designated VGR FOLDED PRECURSOR RNA, is naturally processed by cellular enzymatic activity into at least 4 separate VGAM precursor RNAs, VGAM247 precursor RNA, VGAM248 precursor RNA, VGAM249 precursor RNA and VGAM250 precursor RNA, herein schematically represented by VGAM1 PRECURSOR, VGAM2 PRECURSOR, VGAM3 PRECURSOR and VGAM4 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM247 RNA, VGAM248 RNA, VGAM249 RNA and VGAM250 RNA respectively, herein schematically represented by VGAM1 RNA, VGAM2 RNA, VGAM3 RNA and VGAM4 RNA respectively, each of which VGAM RNAs corresponding to VGAM RNA of FIG. 8.

VGAM247 RNA, herein schematically represented by VGAM1 binds complimentarily to a host target binding site located in an untranslated region of VGAM247 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM247 host target RNA, herein schematically represented by VGAM1 HOST TARGET RNA into VGAM247 host target protein, herein schematically represented by VGAM1 HOST TARGET PROTEIN, both of FIG. 1.

VGAM248 RNA, herein schematically represented by VGAM2 binds complimentarily to a host target binding site located in an untranslated region of VGAM248 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM248 host target RNA, herein schematically represented by VGAM2 HOST TARGET RNA into VGAM248 host target protein, herein schematically represented by VGAM2 HOST TARGET PROTEIN, both of FIG. 1.

VGAM249 RNA, herein schematically represented by VGAM3 binds complimentarily to a host target binding site located in an untranslated region of VGAM249 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM249 host target RNA, herein schematically represented by VGAM3 HOST TARGET RNA into VGAM249 host target protein, herein schematically represented by VGAM3 HOST TARGET PROTEIN, both of FIG. 1.

VGAM250 RNA, herein schematically represented by VGAM4 binds complimentarily to a host target binding site located in an untranslated region of VGAM250 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM250 host target RNA, herein schematically represented by VGAM4 HOST TARGET RNA into VGAM250 host target protein, herein schematically represented by VGAM4 HOST TARGET PROTEIN, both of FIG. 1.

It is appreciated that a function of VGR418 gene, herein designated VGR GENE, is inhibition of expression of host target genes, as part of a novel viral mechanism of attacking a host. Accordingly, utilities of VGR418 gene include diagnosis, prevention and treatment of viral infection by. Specific functions, and accordingly utilities, of VGR418 gene, herein designated VGR GENE, correlate with, and may be deduced from, the identity of the host target genes, which are inhibited by VGAM RNAs comprised in the operon-like cluster of VGR418 gene: VGAM247 host target protein, VGAM248 host target protein, VGAM249 host target protein and VGAM250 host target protein, herein schematically represented by VGAM1 HOST TARGET PROTEIN through VGAM HOST TARGET PROTEIN respectively. The function of these host target genes is elaborated hereinabove with reference to VGAM247, VGAM248, VGAM249 and VGAM250

FIG. 9 further provides a conceptual description of novel bioinformatically detected regulatory viral gene, referred to here as Viral Genomic Record 419(VGR419) viral gene, which encodes an operon-like cluster of novel viral micro RNA-like genes, each of which in turn modulates expression of at least one host target gene, the function and utility of which at least one host target gene is known in the art.

VGR419 gene, herein designated VGR GENE, is a novel bioinformatically detected regulatory, non protein coding, RNA viral gene. The method by which VGR419 gene was detected is described hereinabove with reference to FIGS. 6-15.

VGR419 gene encodes VGR419 precursor RNA, herein designated VGR PRECURSOR RNA, an RNA molecule, typically several hundred nucleotides long.

VGR419 precursor RNA folds spatially, forming VGR419 folded precursor RNA, herein designated VGR FOLDED PRECURSOR RNA. It is appreciated that VGR419 folded precursor RNA, herein designated VGR FOLDED PRECURSOR RNA, comprises a plurality of what is known in the art as hairpin structures. These hairpin structures are due to the fact that the nucleotide sequence of VGR419 precursor RNA comprises a plurality of segments, the first half of each such segment having a nucleotide sequence which is at least a partial inversed-reversed sequence of the second half thereof, as is well known in the art.

VGR419 folded precursor RNA, herein designated VGR FOLDED PRECURSOR RNA, is naturally processed by cellular enzymatic activity into at least 3 separate VGAM precursor RNAs, VGAM253 precursor RNA, VGAM254 precursor RNA and VGAM255 precursor RNA, herein schematically represented by VGAM1 PRECURSOR, VGAM2 PRECURSOR and VGAM3 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM253 RNA, VGAM254 RNA and VGAM255 RNA respectively, herein schematically represented by VGAM1 RNA, VGAM2 RNA and VGAM3 RNA respectively, each of which VGAM RNAs corresponding to VGAM RNA of FIG. 8.

VGAM253 RNA, herein schematically represented by VGAM1 binds complimentarily to a host target binding site located in an untranslated region of VGAM253 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM253 host target RNA, herein schematically represented by VGAM1 HOST TARGET RNA into VGAM253 host target protein, herein schematically represented by VGAM1 HOST TARGET PROTEIN, both of FIG. 1.

VGAM254 RNA, herein schematically represented by VGAM2 binds complimentarily to a host target binding site located in an untranslated region of VGAM254 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM254 host target RNA, herein schematically represented by VGAM2 HOST TARGET RNA into VGAM254 host target protein, herein schematically represented by VGAM2 HOST TARGET PROTEIN, both of FIG. 1.

VGAM255 RNA, herein schematically represented by VGAM3 binds complimentarily to a host target binding site located in an untranslated region of VGAM255 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM255 host target RNA, herein schematically represented by VGAM3 HOST TARGET RNA into VGAM255 host target protein, herein schematically represented by VGAM3 HOST TARGET PROTEIN, both of FIG. 1.

It is appreciated that a function of VGR419 gene, herein designated VGR GENE, is inhibition of expression of host target genes, as part of a novel viral mechanism of attacking a host. Accordingly, utilities of VGR419 gene include diagnosis, prevention and treatment of viral infection by. Specific functions, and accordingly utilities, of VGR419 gene, herein designated VGR GENE, correlate with, and may be deduced from, the identity of the host target genes, which are inhibited by VGAM RNAs comprised in the operon-like cluster of VGR419 gene: VGAM253 host target protein, VGAM254 host target protein and VGAM255 host target protein, herein schematically represented by VGAM1 HOST TARGET PROTEIN through VGAM HOST TARGET PROTEIN respectively. The function of these host target genes is elaborated hereinabove with reference to VGAM253, VGAM254 and VGAM255

FIG. 9 further provides a conceptual description of novel bioinformatically detected regulatory viral gene, referred to here as Viral Genomic Record 420(VGR420) viral gene, which encodes an operon-like cluster of novel viral micro RNA-like genes, each of which in turn modulates expression of at least one host target gene, the function and utility of which at least one host target gene is known in the art.

VGR420 gene, herein designated VGR GENE, is a novel bioinformatically detected regulatory, non protein coding, RNA viral gene. The method by which VGR420 gene was detected is described hereinabove with reference to FIGS. 6-15.

VGR420 gene encodes VGR420 precursor RNA, herein designated VGR PRECURSOR RNA, an RNA molecule, typically several hundred nucleotides long.

VGR420 precursor RNA folds spatially, forming VGR420 folded precursor RNA, herein designated VGR FOLDED PRECURSOR RNA. It is appreciated that VGR420 folded precursor RNA, herein designated VGR FOLDED PRECURSOR RNA, comprises a plurality of what is known in the art as hairpin structures. These hairpin structures are due to the fact that the nucleotide sequence of VGR420 precursor RNA comprises a plurality of segments, the first half of each such segment having a nucleotide sequence which is at least a partial inversed-reversed sequence of the second half thereof, as is well known in the art.

VGR420 folded precursor RNA, herein designated VGR FOLDED PRECURSOR RNA, is naturally processed by cellular enzymatic activity into at least 2 separate VGAM precursor RNAs, VGAM256 precursor RNA and VGAM257 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM256 RNA and VGAM257 RNA respectively, herein schematically represented by VGAM1 RNA and VGAM2 RNA respectively, each of which VGAM RNAs corresponding to VGAM RNA of FIG. 8.

VGAM256 RNA, herein schematically represented by VGAM1 binds complimentarily to a host target binding site located in an untranslated region of VGAM256 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM256 host target RNA, herein schematically represented by VGAM1 HOST TARGET RNA into VGAM256 host target protein, herein schematically represented by VGAM1 HOST TARGET PROTEIN, both of FIG. 1.

VGAM257 RNA, herein schematically represented by VGAM2 binds complimentarily to a host target binding site located in an untranslated region of VGAM257 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM257 host target RNA, herein schematically represented by VGAM2 HOST TARGET RNA into VGAM257 host target protein, herein schematically represented by VGAM2 HOST TARGET PROTEIN, both of FIG. 1.

It is appreciated that a function of VGR420 gene, herein designated VGR GENE, is inhibition of expression of host target genes, as part of a novel viral mechanism of attacking a host. Accordingly, utilities of VGR420 gene include diagnosis, prevention and treatment of viral infection by. Specific functions, and accordingly utilities, of VGR420 gene, herein designated VGR GENE, correlate with, and may be deduced from, the identity of the host target genes, which are inhibited by VGAM RNAs comprised in the operon-like cluster of VGR420 gene: VGAM256 host target protein and VGAM257 host target protein, herein schematically represented by VGAM1 HOST TARGET PROTEIN and VGAM HOST TARGET PROTEIN respectively. The function of these host target genes is elaborated hereinabove with reference to VGAM256 and VGAM257

FIG. 9 further provides a conceptual description of novel bioinformatically detected regulatory viral gene, referred to here as Viral Genomic Record 421(VGR421) viral gene, which encodes an operon-like cluster of novel viral micro RNA-like genes, each of which in turn modulates expression of at least one host target gene, the function and utility of which at least one host target gene is known in the art.

VGR421 gene, herein designated VGR GENE, is a novel bioinformatically detected regulatory, non protein coding, RNA viral gene. The method by which VGR421 gene was detected is described hereinabove with reference to FIGS. 6-15.

VGR421 gene encodes VGR421 precursor RNA, herein designated VGR PRECURSOR RNA, an RNA molecule, typically several hundred nucleotides long.

VGR421 precursor RNA folds spatially, forming VGR421 folded precursor RNA, herein designated VGR FOLDED PRECURSOR RNA. It is appreciated that VGR421 folded precursor RNA, herein designated VGR FOLDED PRECURSOR RNA, comprises a plurality of what is known in the art as hairpin structures. These hairpin structures are due to the fact that the nucleotide sequence of VGR421 precursor RNA comprises a plurality of segments, the first half of each such segment having a nucleotide sequence which is at least a partial inversed-reversed sequence of the second half thereof, as is well known in the art.

VGR421 folded precursor RNA, herein designated VGR FOLDED PRECURSOR RNA, is naturally processed by cellular enzymatic activity into at least 3 separate VGAM precursor RNAs, VGAM263 precursor RNA, VGAM264 precursor RNA and VGAM265 precursor RNA, herein schematically represented by VGAM1 PRECURSOR, VGAM2 PRECURSOR and VGAM3 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM263 RNA, VGAM264 RNA and VGAM265 RNA respectively, herein schematically represented by VGAM1 RNA, VGAM2 RNA and VGAM3 RNA respectively, each of which VGAM RNAs corresponding to VGAM RNA of FIG. 8.

VGAM263 RNA, herein schematically represented by VGAM1 binds complimentarily to a host target binding site located in an untranslated region of VGAM263 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM263 host target RNA, herein schematically represented by VGAM1 HOST TARGET RNA into VGAM263 host target protein, herein schematically represented by VGAM1 HOST TARGET PROTEIN, both of FIG. 1.

VGAM264 RNA, herein schematically represented by VGAM2 binds complimentarily to a host target binding site located in an untranslated region of VGAM264 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM264 host target RNA, herein schematically represented by VGAM2 HOST TARGET RNA into VGAM264 host target protein, herein schematically represented by VGAM2 HOST TARGET PROTEIN, both of FIG. 1.

VGAM265 RNA, herein schematically represented by VGAM3 binds complimentarily to a host target binding site located in an untranslated region of VGAM265 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM265 host target RNA, herein schematically represented by VGAM3 HOST TARGET RNA into VGAM265 host target protein, herein schematically represented by VGAM3 HOST TARGET PROTEIN, both of FIG. 1.

It is appreciated that a function of VGR421 gene, herein designated VGR GENE, is inhibition of expression of host target genes, as part of a novel viral mechanism of attacking a host. Accordingly, utilities of VGR421 gene include diagnosis, prevention and treatment of viral infection by. Specific functions, and accordingly utilities, of VGR421 gene, herein designated VGR GENE, correlate with, and may be deduced from, the identity of the host target genes, which are inhibited by VGAM RNAs comprised in the operon-like cluster of VGR421 gene: VGAM263 host target protein, VGAM264 host target protein and VGAM265 host target protein, herein schematically represented by VGAM1 HOST TARGET PROTEIN through VGAM HOST TARGET PROTEIN respectively. The function of these host target genes is elaborated hereinabove with reference to VGAM263, VGAM264 and VGAM265

FIG. 9 further provides a conceptual description of novel bioinformatically detected regulatory viral gene, referred to here as Viral Genomic Record 422(VGR422) viral gene, which encodes an operon-like cluster of novel viral micro RNA-like genes, each of which in turn modulates expression of at least one host target gene, the function and utility of which at least one host target gene is known in the art.

VGR422 gene, herein designated VGR GENE, is a novel bioinformatically detected regulatory, non protein coding, RNA viral gene. The method by which VGR422 gene was detected is described hereinabove with reference to FIGS. 6-15.

VGR422 gene encodes VGR422 precursor RNA, herein designated VGR PRECURSOR RNA, an RNA molecule, typically several hundred nucleotides long.

VGR422 precursor RNA folds spatially, forming VGR422 folded precursor RNA, herein designated VGR FOLDED PRECURSOR RNA. It is appreciated that VGR422 folded precursor RNA, herein designated VGR FOLDED PRECURSOR RNA, comprises a plurality of what is known in the art as hairpin structures. These hairpin structures are due to the fact that the nucleotide sequence of VGR422 precursor RNA comprises a plurality of segments, the first half of each such segment having a nucleotide sequence which is at least a partial inversed-reversed sequence of the second half thereof, as is well known in the art.

VGR422 folded precursor RNA, herein designated VGR FOLDED PRECURSOR RNA, is naturally processed by cellular enzymatic activity into at least 2 separate VGAM precursor RNAs, VGAM266 precursor RNA and VGAM267 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM266 RNA and VGAM267 RNA respectively, herein schematically represented by VGAM1 RNA and VGAM2 RNA respectively, each of which VGAM RNAs corresponding to VGAM RNA of FIG. 8.

VGAM266 RNA, herein schematically represented by VGAM1 binds complimentarily to a host target binding site located in an untranslated region of VGAM266 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM266 host target RNA, herein schematically represented by VGAM1 HOST TARGET RNA into VGAM266 host target protein, herein schematically represented by VGAM1 HOST TARGET PROTEIN, both of FIG. 1.

VGAM267 RNA, herein schematically represented by VGAM2 binds complimentarily to a host target binding site located in an untranslated region of VGAM267 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM267 host target RNA, herein schematically represented by VGAM2 HOST TARGET RNA into VGAM267 host target protein, herein schematically represented by VGAM2 HOST TARGET PROTEIN, both of FIG. 1.

It is appreciated that a function of VGR422 gene, herein designated VGR GENE, is inhibition of expression of host target genes, as part of a novel viral mechanism of attacking a host. Accordingly, utilities of VGR422 gene include diagnosis, prevention and treatment of viral infection by. Specific functions, and accordingly utilities, of VGR422 gene, herein designated VGR GENE, correlate with, and may be deduced from, the identity of the host target genes, which are inhibited by VGAM RNAs comprised in the operon-like cluster of VGR422 gene: VGAM266 host target protein and VGAM267 host target protein, herein schematically represented by VGAM1 HOST TARGET PROTEIN and VGAM HOST TARGET PROTEIN respectively. The function of these host target genes is elaborated hereinabove with reference to VGAM266 and VGAM267

FIG. 9 further provides a conceptual description of novel bioinformatically detected regulatory viral gene, referred to here as Viral Genomic Record 423(VGR423) viral gene, which encodes an operon-like cluster of novel viral micro RNA-like genes, each of which in turn modulates expression of at least one host target gene, the function and utility of which at least one host target gene is known in the art.

VGR423 gene, herein designated VGR GENE, is a novel bioinformatically detected regulatory, non protein coding, RNA viral gene. The method by which VGR423 gene was detected is described hereinabove with reference to FIGS. 6-15.

VGR423 gene encodes VGR423 precursor RNA, herein designated VGR PRECURSOR RNA, an RNA molecule, typically several hundred nucleotides long.

VGR423 precursor RNA folds spatially, forming VGR423 folded precursor RNA, herein designated VGR FOLDED PRECURSOR RNA. It is appreciated that VGR423 folded precursor RNA, herein designated VGR FOLDED PRECURSOR RNA, comprises a plurality of what is known in the art as hairpin structures. These hairpin structures are due to the fact that the nucleotide sequence of VGR423 precursor RNA comprises a plurality of segments, the first half of each such segment having a nucleotide sequence which is at least a partial inversed-reversed sequence of the second half thereof, as is well known in the art.

VGR423 folded precursor RNA, herein designated VGR FOLDED PRECURSOR RNA, is naturally processed by cellular enzymatic activity into at least 3 separate VGAM precursor RNAs, VGAM268 precursor RNA, VGAM269 precursor RNA and VGAM270 precursor RNA, herein schematically represented by VGAM1 PRECURSOR, VGAM2 PRECURSOR and VGAM3 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM268 RNA, VGAM269 RNA and VGAM270 RNA respectively, herein schematically represented by VGAM1 RNA, VGAM2 RNA and VGAM3 RNA respectively, each of which VGAM RNAs corresponding to VGAM RNA of FIG. 8.

VGAM268 RNA, herein schematically represented by VGAM1 binds complimentarily to a host target binding site located in an untranslated region of VGAM268 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM268 host target RNA, herein schematically represented by VGAM1 HOST TARGET RNA into VGAM268 host target protein, herein schematically represented by VGAM1 HOST TARGET PROTEIN, both of FIG. 1.

VGAM269 RNA, herein schematically represented by VGAM2 binds complimentarily to a host target binding site located in an untranslated region of VGAM269 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM269 host target RNA, herein schematically represented by VGAM2 HOST TARGET RNA into VGAM269 host target protein, herein schematically represented by VGAM2 HOST TARGET PROTEIN, both of FIG. 1.

VGAM270 RNA, herein schematically represented by VGAM3 binds complimentarily to a host target binding site located in an untranslated region of VGAM270 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM270 host target RNA, herein schematically represented by VGAM3 HOST TARGET RNA into VGAM270 host target protein, herein schematically represented by VGAM3 HOST TARGET PROTEIN, both of FIG. 1.

It is appreciated that a function of VGR423 gene, herein designated VGR GENE, is inhibition of expression of host target genes, as part of a novel viral mechanism of attacking a host. Accordingly, utilities of VGR423 gene include diagnosis, prevention and treatment of viral infection by. Specific functions, and accordingly utilities, of VGR423 gene, herein designated VGR GENE, correlate with, and may be deduced from, the identity of the host target genes, which are inhibited by VGAM RNAs comprised in the operon-like cluster of VGR423 gene: VGAM268 host target protein, VGAM269 host target protein and VGAM270 host target protein, herein schematically represented by VGAM1 HOST TARGET PROTEIN through VGAM HOST TARGET PROTEIN respectively. The function of these host target genes is elaborated hereinabove with reference to VGAM268, VGAM269 and VGAM270

FIG. 9 further provides a conceptual description of novel bioinformatically detected regulatory viral gene, referred to here as Viral Genomic Record 424(VGR424) viral gene, which encodes an operon-like cluster of novel viral micro RNA-like genes, each of which in turn modulates expression of at least one host target gene, the function and utility of which at least one host target gene is known in the art.

VGR424 gene, herein designated VGR GENE, is a novel bioinformatically detected regulatory, non protein coding, RNA viral gene. The method by which VGR424 gene was detected is described hereinabove with reference to FIGS. 6-15.

VGR424 gene encodes VGR424 precursor RNA, herein designated VGR PRECURSOR RNA, an RNA molecule, typically several hundred nucleotides long.

VGR424 precursor RNA folds spatially, forming VGR424 folded precursor RNA, herein designated VGR FOLDED PRECURSOR RNA. It is appreciated that VGR424 folded precursor RNA, herein designated VGR FOLDED PRECURSOR RNA, comprises a plurality of what is known in the art as hairpin structures. These hairpin structures are due to the fact that the nucleotide sequence of VGR424 precursor RNA comprises a plurality of segments, the first half of each such segment having a nucleotide sequence which is at least a partial inversed-reversed sequence of the second half thereof, as is well known in the art.

VGR424 folded precursor RNA, herein designated VGR FOLDED PRECURSOR RNA, is naturally processed by cellular enzymatic activity into at least 2 separate VGAM precursor RNAs, VGAM272 precursor RNA and VGAM273 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM272 RNA and VGAM273 RNA respectively, herein schematically represented by VGAM1 RNA and VGAM2 RNA respectively, each of which VGAM RNAs corresponding to VGAM RNA of FIG. 8.

VGAM272 RNA, herein schematically represented by VGAM1 binds complimentarily to a host target binding site located in an untranslated region of VGAM272 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM272 host target RNA, herein schematically represented by VGAM1 HOST TARGET RNA into VGAM272 host target protein, herein schematically represented by VGAM1 HOST TARGET PROTEIN, both of FIG. 1.

VGAM273 RNA, herein schematically represented by VGAM2 binds complimentarily to a host target binding site located in an untranslated region of VGAM273 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM273 host target RNA, herein schematically represented by VGAM2 HOST TARGET RNA into VGAM273 host target protein, herein schematically represented by VGAM2 HOST TARGET PROTEIN, both of FIG. 1.

It is appreciated that a function of VGR424 gene, herein designated VGR GENE, is inhibition of expression of host target genes, as part of a novel viral mechanism of attacking a host. Accordingly, utilities of VGR424 gene include diagnosis, prevention and treatment of viral infection by. Specific functions, and accordingly utilities, of VGR424 gene, herein designated VGR GENE, correlate with, and may be deduced from, the identity of the host target genes, which are inhibited by VGAM RNAs comprised in the operon-like cluster of VGR424 gene: VGAM272 host target protein and VGAM273 host target protein, herein schematically represented by VGAM1 HOST TARGET PROTEIN and VGAM HOST TARGET PROTEIN respectively. The function of these host target genes is elaborated hereinabove with reference to VGAM272 and VGAM273

FIG. 9 further provides a conceptual description of novel bioinformatically detected regulatory viral gene, referred to here as Viral Genomic Record 425(VGR425) viral gene, which encodes an operon-like cluster of novel viral micro RNA-like genes, each of which in turn modulates expression of at least one host target gene, the function and utility of which at least one host target gene is known in the art.

VGR425 gene, herein designated VGR GENE, is a novel bioinformatically detected regulatory, non protein coding, RNA viral gene. The method by which VGR425 gene was detected is described hereinabove with reference to FIGS. 6-15.

VGR425 gene encodes VGR425 precursor RNA, herein designated VGR PRECURSOR RNA, an RNA molecule, typically several hundred nucleotides long.

VGR425 precursor RNA folds spatially, forming VGR425 folded precursor RNA, herein designated VGR FOLDED PRECURSOR RNA. It is appreciated that VGR425 folded precursor RNA, herein designated VGR FOLDED PRECURSOR RNA, comprises a plurality of what is known in the art as hairpin structures. These hairpin structures are due to the fact that the nucleotide sequence of VGR425 precursor RNA comprises a plurality of segments, the first half of each such segment having a nucleotide sequence which is at least a partial inversed-reversed sequence of the second half thereof, as is well known in the art.

VGR425 folded precursor RNA, herein designated VGR FOLDED PRECURSOR RNA, is naturally processed by cellular enzymatic activity into at least 4 separate VGAM precursor RNAs, VGAM274 precursor RNA, VGAM275 precursor RNA, VGAM276 precursor RNA and VGAM277 precursor RNA, herein schematically represented by VGAM1 PRECURSOR, VGAM2 PRECURSOR, VGAM3 PRECURSOR and VGAM4 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM274 RNA, VGAM275 RNA, VGAM276 RNA and VGAM277 RNA respectively, herein schematically represented by VGAM1 RNA, VGAM2 RNA, VGAM3 RNA and VGAM4 RNA respectively, each of which VGAM RNAs corresponding to VGAM RNA of FIG. 8.

VGAM274 RNA, herein schematically represented by VGAM1 binds complimentarily to a host target binding site located in an untranslated region of VGAM274 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM274 host target RNA, herein schematically represented by VGAM1 HOST TARGET RNA into VGAM274 host target protein, herein schematically represented by VGAM1 HOST TARGET PROTEIN, both of FIG. 1.

VGAM275 RNA, herein schematically represented by VGAM2 binds complimentarily to a host target binding site located in an untranslated region of VGAM275 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM275 host target RNA, herein schematically represented by VGAM2 HOST TARGET RNA into VGAM275 host target protein, herein schematically represented by VGAM2 HOST TARGET PROTEIN, both of FIG. 1.

VGAM276 RNA, herein schematically represented by VGAM3 binds complimentarily to a host target binding site located in an untranslated region of VGAM276 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM276 host target RNA, herein schematically represented by VGAM3 HOST TARGET RNA into VGAM276 host target protein, herein schematically represented by VGAM3 HOST TARGET PROTEIN, both of FIG. 1.

VGAM277 RNA, herein schematically represented by VGAM4 binds complimentarily to a host target binding site located in an untranslated region of VGAM277 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM277 host target RNA, herein schematically represented by VGAM4 HOST TARGET RNA into VGAM277 host target protein, herein schematically represented by VGAM4 HOST TARGET PROTEIN, both of FIG. 1.

It is appreciated that a function of VGR425 gene, herein designated VGR GENE, is inhibition of expression of host target genes, as part of a novel viral mechanism of attacking a host. Accordingly, utilities of VGR425 gene include diagnosis, prevention and treatment of viral infection by. Specific functions, and accordingly utilities, of VGR425 gene, herein designated VGR GENE, correlate with, and may be deduced from, the identity of the host target genes, which are inhibited by VGAM RNAs comprised in the operon-like cluster of VGR425 gene: VGAM274 host target protein, VGAM275 host target protein, VGAM276 host target protein and VGAM277 host target protein, herein schematically represented by VGAM1 HOST TARGET PROTEIN through VGAM HOST TARGET PROTEIN respectively. The function of these host target genes is elaborated hereinabove with reference to VGAM274, VGAM275, VGAM276 and VGAM277

FIG. 9 further provides a conceptual description of novel bioinformatically detected regulatory viral gene, referred to here as Viral Genomic Record 426(VGR426) viral gene, which encodes an operon-like cluster of novel viral micro RNA-like genes, each of which in turn modulates expression of at least one host target gene, the function and utility of which at least one host target gene is known in the art.

VGR426 gene, herein designated VGR GENE, is a novel bioinformatically detected regulatory, non protein coding, RNA viral gene. The method by which VGR426 gene was detected is described hereinabove with reference to FIGS. 6-15.

VGR426 gene encodes VGR426 precursor RNA, herein designated VGR PRECURSOR RNA, an RNA molecule, typically several hundred nucleotides long.

VGR426 precursor RNA folds spatially, forming VGR426 folded precursor RNA, herein designated VGR FOLDED PRECURSOR RNA. It is appreciated that VGR426 folded precursor RNA, herein designated VGR FOLDED PRECURSOR RNA, comprises a plurality of what is known in the art as hairpin structures. These hairpin structures are due to the fact that the nucleotide sequence of VGR426 precursor RNA comprises a plurality of segments, the first half of each such segment having a nucleotide sequence which is at least a partial inversed-reversed sequence of the second half thereof, as is well known in the art.

VGR426 folded precursor RNA, herein designated VGR FOLDED PRECURSOR RNA, is naturally processed by cellular enzymatic activity into at least 5 separate VGAM precursor RNAs, VGAM279 precursor RNA, VGAM280 precursor RNA, VGAM281 precursor RNA, VGAM282 precursor RNA and VGAM283 precursor RNA, herein schematically represented by VGAM1 PRECURSOR, VGAM2 PRECURSOR, VGAM3 PRECURSOR, VGAM4 PRECURSOR and VGAM5 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM279 RNA, VGAM280 RNA, VGAM281 RNA, VGAM282 RNA and VGAM283 RNA respectively, herein schematically represented by VGAM1 RNA, VGAM2 RNA, VGAM3 RNA, VGAM4 RNA and VGAM5 RNA respectively, each of which VGAM RNAs corresponding to VGAM RNA of FIG. 8.

VGAM279 RNA, herein schematically represented by VGAM1 binds complimentarily to a host target binding site located in an untranslated region of VGAM279 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM279 host target RNA, herein schematically represented by VGAM1 HOST TARGET RNA into VGAM279 host target protein, herein schematically represented by VGAM1 HOST TARGET PROTEIN, both of FIG. 1.

VGAM280 RNA, herein schematically represented by VGAM2 binds complimentarily to a host target binding site located in an untranslated region of VGAM280 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM280 host target RNA, herein schematically represented by VGAM2 HOST TARGET RNA into VGAM280 host target protein, herein schematically represented by VGAM2 HOST TARGET PROTEIN, both of FIG. 1.

VGAM281 RNA, herein schematically represented by VGAM3 binds complimentarily to a host target binding site located in an untranslated region of VGAM281 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM281 host target RNA, herein schematically represented by VGAM3 HOST TARGET RNA into VGAM281 host target protein, herein schematically represented by VGAM3 HOST TARGET PROTEIN, both of FIG. 1.

VGAM282 RNA, herein schematically represented by VGAM4 binds complimentarily to a host target binding site located in an untranslated region of VGAM282 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM282 host target RNA, herein schematically represented by VGAM4 HOST TARGET RNA into VGAM282 host target protein, herein schematically represented by VGAM4 HOST TARGET PROTEIN, both of FIG. 1.

VGAM283 RNA, herein schematically represented by VGAM5 binds complimentarily to a host target binding site located in an untranslated region of VGAM283 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM283 host target RNA, herein schematically represented by VGAM5 HOST TARGET RNA into VGAM283 host target protein, herein schematically represented by VGAM5 HOST TARGET PROTEIN, both of FIG. 1.

It is appreciated that a function of VGR426 gene, herein designated VGR GENE, is inhibition of expression of host target genes, as part of a novel viral mechanism of attacking a host. Accordingly, utilities of VGR426 gene include diagnosis, prevention and treatment of viral infection by. Specific functions, and accordingly utilities, of VGR426 gene, herein designated VGR GENE, correlate with, and may be deduced from, the identity of the host target genes, which are inhibited by VGAM RNAs comprised in the operon-like cluster of VGR426 gene: VGAM279 host target protein, VGAM280 host target protein, VGAM281 host target protein, VGAM282 host target protein and VGAM283 host target protein, herein schematically represented by VGAM1 HOST TARGET PROTEIN through VGAM HOST TARGET PROTEIN respectively. The function of these host target genes is elaborated hereinabove with reference to VGAM279, VGAM280, VGAM281, VGAM282 and VGAM283

FIG. 9 further provides a conceptual description of novel bioinformatically detected regulatory viral gene, referred to here as Viral Genomic Record 427(VGR427) viral gene, which encodes an operon-like cluster of novel viral micro RNA-like genes, each of which in turn modulates expression of at least one host target gene, the function and utility of which at least one host target gene is known in the art.

VGR427 gene, herein designated VGR GENE, is a novel bioinformatically detected regulatory, non protein coding, RNA viral gene. The method by which VGR427 gene was detected is described hereinabove with reference to FIGS. 6-15.

VGR427 gene encodes VGR427 precursor RNA, herein designated VGR PRECURSOR RNA, an RNA molecule, typically several hundred nucleotides long.

VGR427 precursor RNA folds spatially, forming VGR427 folded precursor RNA, herein designated VGR FOLDED PRECURSOR RNA. It is appreciated that VGR427 folded precursor RNA, herein designated VGR FOLDED PRECURSOR RNA, comprises a plurality of what is known in the art as hairpin structures. These hairpin structures are due to the fact that the nucleotide sequence of VGR427 precursor RNA comprises a plurality of segments, the first half of each such segment having a nucleotide sequence which is at least a partial inversed-reversed sequence of the second half thereof, as is well known in the art.

VGR427 folded precursor RNA, herein designated VGR FOLDED PRECURSOR RNA, is naturally processed by cellular enzymatic activity into at least 4 separate VGAM precursor RNAs, VGAM288 precursor RNA, VGAM289 precursor RNA, VGAM290 precursor RNA and VGAM291 precursor RNA, herein schematically represented by VGAM1 PRECURSOR, VGAM2 PRECURSOR, VGAM3 PRECURSOR and VGAM4 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM288 RNA, VGAM289 RNA, VGAM290 RNA and VGAM291 RNA respectively, herein schematically represented by VGAM1 RNA, VGAM2 RNA, VGAM3 RNA and VGAM4 RNA respectively, each of which VGAM RNAs corresponding to VGAM RNA of FIG. 8.

VGAM288 RNA, herein schematically represented by VGAM1 binds complimentarily to a host target binding site located in an untranslated region of VGAM288 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM288 host target RNA, herein schematically represented by VGAM1 HOST TARGET RNA into VGAM288 host target protein, herein schematically represented by VGAM1 HOST TARGET PROTEIN, both of FIG. 1.

VGAM289 RNA, herein schematically represented by VGAM2 binds complimentarily to a host target binding site located in an untranslated region of VGAM289 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM289 host target RNA, herein schematically represented by VGAM2 HOST TARGET RNA into VGAM289 host target protein, herein schematically represented by VGAM2 HOST TARGET PROTEIN, both of FIG. 1.

VGAM290 RNA, herein schematically represented by VGAM3 binds complimentarily to a host target binding site located in an untranslated region of VGAM290 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM290 host target RNA, herein schematically represented by VGAM3 HOST TARGET RNA into VGAM290 host target protein, herein schematically represented by VGAM3 HOST TARGET PROTEIN, both of FIG. 1.

VGAM291 RNA, herein schematically represented by VGAM4 binds complimentarily to a host target binding site located in an untranslated region of VGAM291 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM291 host target RNA, herein schematically represented by VGAM4 HOST TARGET RNA into VGAM291 host target protein, herein schematically represented by VGAM4 HOST TARGET PROTEIN, both of FIG. 1.

It is appreciated that a function of VGR427 gene, herein designated VGR GENE, is inhibition of expression of host target genes, as part of a novel viral mechanism of attacking a host. Accordingly, utilities of VGR427 gene include diagnosis, prevention and treatment of viral infection by. Specific functions, and accordingly utilities, of VGR427 gene, herein designated VGR GENE, correlate with, and may be deduced from, the identity of the host target genes, which are inhibited by VGAM RNAs comprised in the operon-like cluster of VGR427 gene: VGAM288 host target protein, VGAM289 host target protein, VGAM290 host target protein and VGAM291 host target protein, herein schematically represented by VGAM1 HOST TARGET PROTEIN through VGAM HOST TARGET PROTEIN respectively. The function of these host target genes is elaborated hereinabove with reference to VGAM288, VGAM289, VGAM290 and VGAM291

FIG. 9 further provides a conceptual description of novel bioinformatically detected regulatory viral gene, referred to here as Viral Genomic Record 428(VGR428) viral gene, which encodes an operon-like cluster of novel viral micro RNA-like genes, each of which in turn modulates expression of at least one host target gene, the function and utility of which at least one host target gene is known in the art.

VGR428 gene, herein designated VGR GENE, is a novel bioinformatically detected regulatory, non protein coding, RNA viral gene. The method by which VGR428 gene was detected is described hereinabove with reference to FIGS. 6-15.

VGR428 gene encodes VGR428 precursor RNA, herein designated VGR PRECURSOR RNA, an RNA molecule, typically several hundred nucleotides long.

VGR428 precursor RNA folds spatially, forming VGR428 folded precursor RNA, herein designated VGR FOLDED PRECURSOR RNA. It is appreciated that VGR428 folded precursor RNA, herein designated VGR FOLDED PRECURSOR RNA, comprises a plurality of what is known in the art as hairpin structures. These hairpin structures are due to the fact that the nucleotide sequence of VGR428 precursor RNA comprises a plurality of segments, the first half of each such segment having a nucleotide sequence which is at least a partial inversed-reversed sequence of the second half thereof, as is well known in the art.

VGR428 folded precursor RNA, herein designated VGR FOLDED PRECURSOR RNA, is naturally processed by cellular enzymatic activity into at least 3 separate VGAM precursor RNAs, VGAM292 precursor RNA, VGAM293 precursor RNA and VGAM294 precursor RNA, herein schematically represented by VGAM1 PRECURSOR, VGAM2 PRECURSOR and VGAM3 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM292 RNA, VGAM293 RNA and VGAM294 RNA respectively, herein schematically represented by VGAM1 RNA, VGAM2 RNA and VGAM3 RNA respectively, each of which VGAM RNAs corresponding to VGAM RNA of FIG. 8.

VGAM292 RNA, herein schematically represented by VGAM1 binds complimentarily to a host target binding site located in an untranslated region of VGAM292 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM292 host target RNA, herein schematically represented by VGAM1 HOST TARGET RNA into VGAM292 host target protein, herein schematically represented by VGAM1 HOST TARGET PROTEIN, both of FIG. 1.

VGAM293 RNA, herein schematically represented by VGAM2 binds complimentarily to a host target binding site located in an untranslated region of VGAM293 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM293 host target RNA, herein schematically represented by VGAM2 HOST TARGET RNA into VGAM293 host target protein, herein schematically represented by VGAM2 HOST TARGET PROTEIN, both of FIG. 1.

VGAM294 RNA, herein schematically represented by VGAM3 binds complimentarily to a host target binding site located in an untranslated region of VGAM294 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM294 host target RNA, herein schematically represented by VGAM3 HOST TARGET RNA into VGAM294 host target protein, herein schematically represented by VGAM3 HOST TARGET PROTEIN, both of FIG. 1.

It is appreciated that a function of VGR428 gene, herein designated VGR GENE, is inhibition of expression of host target genes, as part of a novel viral mechanism of attacking a host. Accordingly, utilities of VGR428 gene include diagnosis, prevention and treatment of viral infection by. Specific functions, and accordingly utilities, of VGR428 gene, herein designated VGR GENE, correlate with, and may be deduced from, the identity of the host target genes, which are inhibited by VGAM RNAs comprised in the operon-like cluster of VGR428 gene: VGAM292 host target protein, VGAM293 host target protein and VGAM294 host target protein, herein schematically represented by VGAM1 HOST TARGET PROTEIN through VGAM HOST TARGET PROTEIN respectively. The function of these host target genes is elaborated hereinabove with reference to VGAM292, VGAM293 and VGAM294

FIG. 9 further provides a conceptual description of novel bioinformatically detected regulatory viral gene, referred to here as Viral Genomic Record 429(VGR429) viral gene, which encodes an operon-like cluster of novel viral micro RNA-like genes, each of which in turn modulates expression of at least one host target gene, the function and utility of which at least one host target gene is known in the art.

VGR429 gene, herein designated VGR GENE, is a novel bioinformatically detected regulatory, non protein coding, RNA viral gene. The method by which VGR429 gene was detected is described hereinabove with reference to FIGS. 6-15.

VGR429 gene encodes VGR429 precursor RNA, herein designated VGR PRECURSOR RNA, an RNA molecule, typically several hundred nucleotides long.

VGR429 precursor RNA folds spatially, forming VGR429 folded precursor RNA, herein designated VGR FOLDED PRECURSOR RNA. It is appreciated that VGR429 folded precursor RNA, herein designated VGR FOLDED PRECURSOR RNA, comprises a plurality of what is known in the art as hairpin structures. These hairpin structures are due to the fact that the nucleotide sequence of VGR429 precursor RNA comprises a plurality of segments, the first half of each such segment having a nucleotide sequence which is at least a partial inversed-reversed sequence of the second half thereof, as is well known in the art.

VGR429 folded precursor RNA, herein designated VGR FOLDED PRECURSOR RNA, is naturally processed by cellular enzymatic activity into at least 6 separate VGAM precursor RNAs, VGAM295 precursor RNA, VGAM296 precursor RNA, VGAM297 precursor RNA, VGAM298 precursor RNA, VGAM299 precursor RNA and VGAM300 precursor RNA, herein schematically represented by VGAM1 PRECURSOR, VGAM2 PRECURSOR, VGAM3 PRECURSOR, VGAM4 PRECURSOR, VGAM5 PRECURSOR and VGAM6 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM295 RNA, VGAM296 RNA, VGAM297 RNA, VGAM298 RNA, VGAM299 RNA and VGAM300 RNA respectively, herein schematically represented by VGAM1 RNA, VGAM2 RNA, VGAM3 RNA, VGAM4 RNA, VGAM5 RNA and VGAM6 RNA respectively, each of which VGAM RNAs corresponding to VGAM RNA of FIG. 8.

VGAM295 RNA, herein schematically represented by VGAM1 binds complimentarily to a host target binding site located in an untranslated region of VGAM295 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM295 host target RNA, herein schematically represented by VGAM1 HOST TARGET RNA into VGAM295 host target protein, herein schematically represented by VGAM1 HOST TARGET PROTEIN, both of FIG. 1.

VGAM296 RNA, herein schematically represented by VGAM2 binds complimentarily to a host target binding site located in an untranslated region of VGAM296 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM296 host target RNA, herein schematically represented by VGAM2 HOST TARGET RNA into VGAM296 host target protein, herein schematically represented by VGAM2 HOST TARGET PROTEIN, both of FIG. 1.

VGAM297 RNA, herein schematically represented by VGAM3 binds complimentarily to a host target binding site located in an untranslated region of VGAM297 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM297 host target RNA, herein schematically represented by VGAM3 HOST TARGET RNA into VGAM297 host target protein, herein schematically represented by VGAM3 HOST TARGET PROTEIN, both of FIG. 1.

VGAM298 RNA, herein schematically represented by VGAM4 binds complimentarily to a host target binding site located in an untranslated region of VGAM298 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM298 host target RNA, herein schematically represented by VGAM4 HOST TARGET RNA into VGAM298 host target protein, herein schematically represented by VGAM4 HOST TARGET PROTEIN, both of FIG. 1.

VGAM299 RNA, herein schematically represented by VGAM5 binds complimentarily to a host target binding site located in an untranslated region of VGAM299 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM299 host target RNA, herein schematically represented by VGAM5 HOST TARGET RNA into VGAM299 host target protein, herein schematically represented by VGAM5 HOST TARGET PROTEIN, both of FIG. 1.

VGAM300 RNA, herein schematically represented by VGAM6 binds complimentarily to a host target binding site located in an untranslated region of VGAM300 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM300 host target RNA, herein schematically represented by VGAM6 HOST TARGET RNA into VGAM300 host target protein, herein schematically represented by VGAM6 HOST TARGET PROTEIN, both of FIG. 1.

It is appreciated that a function of VGR429 gene, herein designated VGR GENE, is inhibition of expression of host target genes, as part of a novel viral mechanism of attacking a host. Accordingly, utilities of VGR429 gene include diagnosis, prevention and treatment of viral infection by. Specific functions, and accordingly utilities, of VGR429 gene, herein designated VGR GENE, correlate with, and may be deduced from, the identity of the host target genes, which are inhibited by VGAM RNAs comprised in the operon-like cluster of VGR429 gene: VGAM295 host target protein, VGAM296 host target protein, VGAM297 host target protein, VGAM298 host target protein, VGAM299 host target protein and VGAM300 host target protein, herein schematically represented by VGAM1 HOST TARGET PROTEIN through VGAM HOST TARGET PROTEIN respectively. The function of these host target genes is elaborated hereinabove with reference to VGAM295, VGAM296, VGAM297, VGAM298, VGAM299 and VGAM300

FIG. 9 further provides a conceptual description of novel bioinformatically detected regulatory viral gene, referred to here as Viral Genomic Record 430(VGR430) viral gene, which encodes an operon-like cluster of novel viral micro RNA-like genes, each of which in turn modulates expression of at least one host target gene, the function and utility of which at least one host target gene is known in the art.

VGR430 gene, herein designated VGR GENE, is a novel bioinformatically detected regulatory, non protein coding, RNA viral gene. The method by which VGR430 gene was detected is described hereinabove with reference to FIGS. 6-15.

VGR430 gene encodes VGR430 precursor RNA, herein designated VGR PRECURSOR RNA, an RNA molecule, typically several hundred nucleotides long.

VGR430 precursor RNA folds spatially, forming VGR430 folded precursor RNA, herein designated VGR FOLDED PRECURSOR RNA. It is appreciated that VGR430 folded precursor RNA, herein designated VGR FOLDED PRECURSOR RNA, comprises a plurality of what is known in the art as hairpin structures. These hairpin structures are due to the fact that the nucleotide sequence of VGR430 precursor RNA comprises a plurality of segments, the first half of each such segment having a nucleotide sequence which is at least a partial inversed-reversed sequence of the second half thereof, as is well known in the art.

VGR430 folded precursor RNA, herein designated VGR FOLDED PRECURSOR RNA, is naturally processed by cellular enzymatic activity into at least 8 separate VGAM precursor RNAs, VGAM303 precursor RNA, VGAM304 precursor RNA, VGAM305 precursor RNA, VGAM306 precursor RNA, VGAM307 precursor RNA, VGAM308 precursor RNA, VGAM309 precursor RNA and VGAM310 precursor RNA, herein schematically represented by VGAM1 PRECURSOR, VGAM2 PRECURSOR, VGAM3 PRECURSOR, VGAM4 PRECURSOR, VGAM5 PRECURSOR, VGAM6 PRECURSOR, VGAM7 PRECURSOR and VGAM8 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM303 RNA, VGAM304 RNA, VGAM305 RNA, VGAM306 RNA, VGAM307 RNA, VGAM308 RNA, VGAM309 RNA and VGAM310 RNA respectively, herein schematically represented by VGAM1 RNA, VGAM2 RNA, VGAM3 RNA, VGAM4 RNA, VGAM5 RNA, VGAM6 RNA, VGAM7 RNA and VGAM8 RNA respectively, each of which VGAM RNAs corresponding to VGAM RNA of FIG. 8.

VGAM303 RNA, herein schematically represented by VGAM1 binds complimentarily to a host target binding site located in an untranslated region of VGAM303 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM303 host target RNA, herein schematically represented by VGAM1 HOST TARGET RNA into VGAM303 host target protein, herein schematically represented by VGAM1 HOST TARGET PROTEIN, both of FIG. 1.

VGAM304 RNA, herein schematically represented by VGAM2 binds complimentarily to a host target binding site located in an untranslated region of VGAM304 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM304 host target RNA, herein schematically represented by VGAM2 HOST TARGET RNA into VGAM304 host target protein, herein schematically represented by VGAM2 HOST TARGET PROTEIN, both of FIG. 1.

VGAM305 RNA, herein schematically represented by VGAM3 binds complimentarily to a host target binding site located in an untranslated region of VGAM305 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM305 host target RNA, herein schematically represented by VGAM3 HOST TARGET RNA into VGAM305 host target protein, herein schematically represented by VGAM3 HOST TARGET PROTEIN, both of FIG. 1.

VGAM306 RNA, herein schematically represented by VGAM4 binds complimentarily to a host target binding site located in an untranslated region of VGAM306 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM306 host target RNA, herein schematically represented by VGAM4 HOST TARGET RNA into VGAM306 host target protein, herein schematically represented by VGAM4 HOST TARGET PROTEIN, both of FIG. 1.

VGAM307 RNA, herein schematically represented by VGAM5 binds complimentarily to a host target binding site located in an untranslated region of VGAM307 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM307 host target RNA, herein schematically represented by VGAM5 HOST TARGET RNA into VGAM307 host target protein, herein schematically represented by VGAM5 HOST TARGET PROTEIN, both of FIG. 1.

VGAM308 RNA, herein schematically represented by VGAM6 binds complimentarily to a host target binding site located in an untranslated region of VGAM308 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM308 host target RNA, herein schematically represented by VGAM6 HOST TARGET RNA into VGAM308 host target protein, herein schematically represented by VGAM6 HOST TARGET PROTEIN, both of FIG. 1.

VGAM309 RNA, herein schematically represented by VGAM7 binds complimentarily to a host target binding site located in an untranslated region of VGAM309 host target RNA, herein schematically represented by VGAM7 HOST TARGET RNA, which host target binding site corresponds to a host target binding site such as BINDING SITE I, BINDING SITE II or BINDING SITE III of FIG. 1, thereby inhibiting translation of VGAM309 host target RNA, herein schematically represented by VGAM7 HOST TARGET RNA into VGAM309 host target protein, herein schematically represented by VGAM7 HOST TARGET PROTEIN, both of FIG. 1.

VGAM310 RNA, herein schematically represented by VGAM8 binds complimentarily to a host target binding site located in an untranslated region of VGAM310 host target RNA, herein schematically represented by VGAM8 HOST TARGET RNA, which host target binding site corresponds to a host target binding site such as BINDING SITE I, BINDING SITE II or BINDING SITE III of FIG. 1, thereby inhibiting translation of VGAM310 host target RNA, herein schematically represented by VGAM8 HOST TARGET RNA into VGAM310 host target protein, herein schematically represented by VGAM8 HOST TARGET PROTEIN, both of FIG. 1.

It is appreciated that a function of VGR430 gene, herein designated VGR GENE, is inhibition of expression of host target genes, as part of a novel viral mechanism of attacking a host. Accordingly, utilities of VGR430 gene include diagnosis, prevention and treatment of viral infection by. Specific functions, and accordingly utilities, of VGR430 gene, herein designated VGR GENE, correlate with, and may be deduced from, the identity of the host target genes, which are inhibited by VGAM RNAs comprised in the operon-like cluster of VGR430 gene: VGAM303 host target protein, VGAM304 host target protein, VGAM305 host target protein, VGAM306 host target protein, VGAM307 host target protein, VGAM308 host target protein, VGAM309 host target protein and VGAM310 host target protein, herein schematically represented by VGAM1 HOST TARGET PROTEIN through VGAM HOST TARGET PROTEIN respectively. The function of these host target genes is elaborated hereinabove with reference to VGAM303, VGAM304, VGAM305, VGAM306, VGAM307, VGAM308, VGAM309 and VGAM310

FIG. 9 further provides a conceptual description of novel bioinformatically detected regulatory viral gene, referred to here as Viral Genomic Record 431(VGR431) viral gene, which encodes an operon-like cluster of novel viral micro RNA-like genes, each of which in turn modulates expression of at least one host target gene, the function and utility of which at least one host target gene is known in the art.

VGR431 gene, herein designated VGR GENE, is a novel bioinformatically detected regulatory, non protein coding, RNA viral gene. The method by which VGR431 gene was detected is described hereinabove with reference to FIGS. 6-15.

VGR431 gene encodes VGR431 precursor RNA, herein designated VGR PRECURSOR RNA, an RNA molecule, typically several hundred nucleotides long.

VGR431 precursor RNA folds spatially, forming VGR431 folded precursor RNA, herein designated VGR FOLDED PRECURSOR RNA. It is appreciated that VGR431 folded precursor RNA, herein designated VGR FOLDED PRECURSOR RNA, comprises a plurality of what is known in the art as hairpin structures. These hairpin structures are due to the fact that the nucleotide sequence of VGR431 precursor RNA comprises a plurality of segments, the first half of each such segment having a nucleotide sequence which is at least a partial inversed-reversed sequence of the second half thereof, as is well known in the art.

VGR431 folded precursor RNA, herein designated VGR FOLDED PRECURSOR RNA, is naturally processed by cellular enzymatic activity into at least 4 separate VGAM precursor RNAs, VGAM311 precursor RNA, VGAM312 precursor RNA, VGAM313 precursor RNA and VGAM314 precursor RNA, herein schematically represented by VGAM1 PRECURSOR, VGAM2 PRECURSOR, VGAM3 PRECURSOR and VGAM4 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM311 RNA, VGAM312 RNA, VGAM313 RNA and VGAM314 RNA respectively, herein schematically represented by VGAM1 RNA, VGAM2 RNA, VGAM3 RNA and VGAM4 RNA respectively, each of which VGAM RNAs corresponding to VGAM RNA of FIG. 8.

VGAM311 RNA, herein schematically represented by VGAM1 binds complimentarily to a host target binding site located in an untranslated region of VGAM311 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM311 host target RNA, herein schematically represented by VGAM1 HOST TARGET RNA into VGAM311 host target protein, herein schematically represented by VGAM1 HOST TARGET PROTEIN, both of FIG. 1.

VGAM312 RNA, herein schematically represented by VGAM2 binds complimentarily to a host target binding site located in an untranslated region of VGAM312 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM312 host target RNA, herein schematically represented by VGAM2 HOST TARGET RNA into VGAM312 host target protein, herein schematically represented by VGAM2 HOST TARGET PROTEIN, both of FIG. 1.

VGAM313 RNA, herein schematically represented by VGAM3 binds complimentarily to a host target binding site located in an untranslated region of VGAM313 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM313 host target RNA, herein schematically represented by VGAM3 HOST TARGET RNA into VGAM313 host target protein, herein schematically represented by VGAM3 HOST TARGET PROTEIN, both of FIG. 1.

VGAM314 RNA, herein schematically represented by VGAM4 binds complimentarily to a host target binding site located in an untranslated region of VGAM314 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM314 host target RNA, herein schematically represented by VGAM4 HOST TARGET RNA into VGAM314 host target protein, herein schematically represented by VGAM4 HOST TARGET PROTEIN, both of FIG. 1.

It is appreciated that a function of VGR431 gene, herein designated VGR GENE, is inhibition of expression of host target genes, as part of a novel viral mechanism of attacking a host. Accordingly, utilities of VGR431 gene include diagnosis, prevention and treatment of viral infection by. Specific functions, and accordingly utilities, of VGR431 gene, herein designated VGR GENE, correlate with, and may be deduced from, the identity of the host target genes, which are inhibited by VGAM RNAs comprised in the operon-like cluster of VGR431 gene: VGAM311 host target protein, VGAM312 host target protein, VGAM313 host target protein and VGAM314 host target protein, herein schematically represented by VGAM1 HOST TARGET PROTEIN through VGAM HOST TARGET PROTEIN respectively. The function of these host target genes is elaborated hereinabove with reference to VGAM311, VGAM312, VGAM313 and VGAM314

FIG. 9 further provides a conceptual description of novel bioinformatically detected regulatory viral gene, referred to here as Viral Genomic Record 432(VGR432) viral gene, which encodes an operon-like cluster of novel viral micro RNA-like genes, each of which in turn modulates expression of at least one host target gene, the function and utility of which at least one host target gene is known in the art.

VGR432 gene, herein designated VGR GENE, is a novel bioinformatically detected regulatory, non protein coding, RNA viral gene. The method by which VGR432 gene was detected is described hereinabove with reference to FIGS. 6-15.

VGR432 gene encodes VGR432 precursor RNA, herein designated VGR PRECURSOR RNA, an RNA molecule, typically several hundred nucleotides long.

VGR432 precursor RNA folds spatially, forming VGR432 folded precursor RNA, herein designated VGR FOLDED PRECURSOR RNA. It is appreciated that VGR432 folded precursor RNA, herein designated VGR FOLDED PRECURSOR RNA, comprises a plurality of what is known in the art as hairpin structures. These hairpin structures are due to the fact that the nucleotide sequence of VGR432 precursor RNA comprises a plurality of segments, the first half of each such segment having a nucleotide sequence which is at least a partial inversed-reversed sequence of the second half thereof, as is well known in the art.

VGR432 folded precursor RNA, herein designated VGR FOLDED PRECURSOR RNA, is naturally processed by cellular enzymatic activity into at least 4 separate VGAM precursor RNAs, VGAM316 precursor RNA, VGAM317 precursor RNA, VGAM318 precursor RNA and VGAM319 precursor RNA, herein schematically represented by VGAM1 PRECURSOR, VGAM2 PRECURSOR, VGAM3 PRECURSOR and VGAM4 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM316 RNA, VGAM317 RNA, VGAM318 RNA and VGAM319 RNA respectively, herein schematically represented by VGAM1 RNA, VGAM2 RNA, VGAM3 RNA and VGAM4 RNA respectively, each of which VGAM RNAs corresponding to VGAM RNA of FIG. 8.

VGAM316 RNA, herein schematically represented by VGAM1 binds complimentarily to a host target binding site located in an untranslated region of VGAM316 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM316 host target RNA, herein schematically represented by VGAM1 HOST TARGET RNA into VGAM316 host target protein, herein schematically represented by VGAM1 HOST TARGET PROTEIN, both of FIG. 1.

VGAM317 RNA, herein schematically represented by VGAM2 binds complimentarily to a host target binding site located in an untranslated region of VGAM317 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM317 host target RNA, herein schematically represented by VGAM2 HOST TARGET RNA into VGAM317 host target protein, herein schematically represented by VGAM2 HOST TARGET PROTEIN, both of FIG. 1.

VGAM318 RNA, herein schematically represented by VGAM3 binds complimentarily to a host target binding site located in an untranslated region of VGAM318 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM318 host target RNA, herein schematically represented by VGAM3 HOST TARGET RNA into VGAM318 host target protein, herein schematically represented by VGAM3 HOST TARGET PROTEIN, both of FIG. 1.

VGAM319 RNA, herein schematically represented by VGAM4 binds complimentarily to a host target binding site located in an untranslated region of VGAM319 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM319 host target RNA, herein schematically represented by VGAM4 HOST TARGET RNA into VGAM319 host target protein, herein schematically represented by VGAM4 HOST TARGET PROTEIN, both of FIG. 1.

It is appreciated that a function of VGR432 gene, herein designated VGR GENE, is inhibition of expression of host target genes, as part of a novel viral mechanism of attacking a host. Accordingly, utilities of VGR432 gene include diagnosis, prevention and treatment of viral infection by. Specific functions, and accordingly utilities, of VGR432 gene, herein designated VGR GENE, correlate with, and may be deduced from, the identity of the host target genes, which are inhibited by VGAM RNAs comprised in the operon-like cluster of VGR432 gene: VGAM316 host target protein, VGAM317 host target protein, VGAM318 host target protein and VGAM319 host target protein, herein schematically represented by VGAM1 HOST TARGET PROTEIN through VGAM HOST TARGET PROTEIN respectively. The function of these host target genes is elaborated hereinabove with reference to VGAM316, VGAM317, VGAM318 and VGAM319

FIG. 9 further provides a conceptual description of novel bioinformatically detected regulatory viral gene, referred to here as Viral Genomic Record 433(VGR433) viral gene, which encodes an operon-like cluster of novel viral micro RNA-like genes, each of which in turn modulates expression of at least one host target gene, the function and utility of which at least one host target gene is known in the art.

VGR433 gene, herein designated VGR GENE, is a novel bioinformatically detected regulatory, non protein coding, RNA viral gene. The method by which VGR433 gene was detected is described hereinabove with reference to FIGS. 6-15.

VGR433 gene encodes VGR433 precursor RNA, herein designated VGR PRECURSOR RNA, an RNA molecule, typically several hundred nucleotides long.

VGR433 precursor RNA folds spatially, forming VGR433 folded precursor RNA, herein designated VGR FOLDED PRECURSOR RNA. It is appreciated that VGR433 folded precursor RNA, herein designated VGR FOLDED PRECURSOR RNA, comprises a plurality of what is known in the art as hairpin structures. These hairpin structures are due to the fact that the nucleotide sequence of VGR433 precursor RNA comprises a plurality of segments, the first half of each such segment having a nucleotide sequence which is at least a partial inversed-reversed sequence of the second half thereof, as is well known in the art.

VGR433 folded precursor RNA, herein designated VGR FOLDED PRECURSOR RNA, is naturally processed by cellular enzymatic activity into at least 8 separate VGAM precursor RNAs, VGAM320 precursor RNA, VGAM321 precursor RNA, VGAM322 precursor RNA, VGAM323 precursor RNA, VGAM324 precursor RNA, VGAM325 precursor RNA, VGAM326 precursor RNA and VGAM327 precursor RNA, herein schematically represented by VGAM1 PRECURSOR, VGAM2 PRECURSOR, VGAM3 PRECURSOR, VGAM4 PRECURSOR, VGAM5 PRECURSOR, VGAM6 PRECURSOR, VGAM7 PRECURSOR and VGAM8 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM320 RNA, VGAM321 RNA, VGAM322 RNA, VGAM323 RNA, VGAM324 RNA, VGAM325 RNA, VGAM326 RNA and VGAM327 RNA respectively, herein schematically represented by VGAM1 RNA, VGAM2 RNA, VGAM3 RNA, VGAM4 RNA, VGAM5 RNA, VGAM6 RNA, VGAM7 RNA and VGAM8 RNA respectively, each of which VGAM RNAs corresponding to VGAM RNA of FIG. 8.

VGAM320 RNA, herein schematically represented by VGAM1 binds complimentarily to a host target binding site located in an untranslated region of VGAM320 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM320 host target RNA, herein schematically represented by VGAM1 HOST TARGET RNA into VGAM320 host target protein, herein schematically represented by VGAM1 HOST TARGET PROTEIN, both of FIG. 1.

VGAM321 RNA, herein schematically represented by VGAM2 binds complimentarily to a host target binding site located in an untranslated region of VGAM321 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM321 host target RNA, herein schematically represented by VGAM2 HOST TARGET RNA into VGAM321 host target protein, herein schematically represented by VGAM2 HOST TARGET PROTEIN, both of FIG. 1.

VGAM322 RNA, herein schematically represented by VGAM3 binds complimentarily to a host target binding site located in an untranslated region of VGAM322 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM322 host target RNA, herein schematically represented by VGAM3 HOST TARGET RNA into VGAM322 host target protein, herein schematically represented by VGAM3 HOST TARGET PROTEIN, both of FIG. 1.

VGAM323 RNA, herein schematically represented by VGAM4 binds complimentarily to a host target binding site located in an untranslated region of VGAM323 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM323 host target RNA, herein schematically represented by VGAM4 HOST TARGET RNA into VGAM323 host target protein, herein schematically represented by VGAM4 HOST TARGET PROTEIN, both of FIG. 1.

VGAM324 RNA, herein schematically represented by VGAM5 binds complimentarily to a host target binding site located in an untranslated region of VGAM324 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM324 host target RNA, herein schematically represented by VGAM5 HOST TARGET RNA into VGAM324 host target protein, herein schematically represented by VGAM5 HOST TARGET PROTEIN, both of FIG. 1.

VGAM325 RNA, herein schematically represented by VGAM6 binds complimentarily to a host target binding site located in an untranslated region of VGAM325 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM325 host target RNA, herein schematically represented by VGAM6 HOST TARGET RNA into VGAM325 host target protein, herein schematically represented by VGAM6 HOST TARGET PROTEIN, both of FIG. 1.

VGAM326 RNA, herein schematically represented by VGAM7 binds complimentarily to a host target binding site located in an untranslated region of VGAM326 host target RNA, herein schematically represented by VGAM7 HOST TARGET RNA, which host target binding site corresponds to a host target binding site such as BINDING SITE I, BINDING SITE II or BINDING SITE III of FIG. 1, thereby inhibiting translation of VGAM326 host target RNA, herein schematically represented by VGAM7 HOST TARGET RNA into VGAM326 host target protein, herein schematically represented by VGAM7 HOST TARGET PROTEIN, both of FIG. 1.

VGAM327 RNA, herein schematically represented by VGAM8 binds complimentarily to a host target binding site located in an untranslated region of VGAM327 host target RNA, herein schematically represented by VGAM8 HOST TARGET RNA, which host target binding site corresponds to a host target binding site such as BINDING SITE I, BINDING SITE II or BINDING SITE III of FIG. 1, thereby inhibiting translation of VGAM327 host target RNA, herein schematically represented by VGAM8 HOST TARGET RNA into VGAM327 host target protein, herein schematically represented by VGAM8 HOST TARGET PROTEIN, both of FIG. 1.

It is appreciated that a function of VGR433 gene, herein designated VGR GENE, is inhibition of expression of host target genes, as part of a novel viral mechanism of attacking a host. Accordingly, utilities of VGR433 gene include diagnosis, prevention and treatment of viral infection by. Specific functions, and accordingly utilities, of VGR433 gene, herein designated VGR GENE, correlate with, and may be deduced from, the identity of the host target genes, which are inhibited by VGAM RNAs comprised in the operon-like cluster of VGR433 gene: VGAM320 host target protein, VGAM321 host target protein, VGAM322 host target protein, VGAM323 host target protein, VGAM324 host target protein, VGAM325 host target protein, VGAM326 host target protein and VGAM327 host target protein, herein schematically represented by VGAM1 HOST TARGET PROTEIN through VGAM HOST TARGET PROTEIN respectively. The function of these host target genes is elaborated hereinabove with reference to VGAM320, VGAM321, VGAM322, VGAM323, VGAM324, VGAM325, VGAM326 and VGAM327

FIG. 9 further provides a conceptual description of novel bioinformatically detected regulatory viral gene, referred to here as Viral Genomic Record 434(VGR434) viral gene, which encodes an operon-like cluster of novel viral micro RNA-like genes, each of which in turn modulates expression of at least one host target gene, the function and utility of which at least one host target gene is known in the art.

VGR434 gene, herein designated VGR GENE, is a novel bioinformatically detected regulatory, non protein coding, RNA viral gene. The method by which VGR434 gene was detected is described hereinabove with reference to FIGS. 6-15.

VGR434 gene encodes VGR434 precursor RNA, herein designated VGR PRECURSOR RNA, an RNA molecule, typically several hundred nucleotides long.

VGR434 precursor RNA folds spatially, forming VGR434 folded precursor RNA, herein designated VGR FOLDED PRECURSOR RNA. It is appreciated that VGR434 folded precursor RNA, herein designated VGR FOLDED PRECURSOR RNA, comprises a plurality of what is known in the art as hairpin structures. These hairpin structures are due to the fact that the nucleotide sequence of VGR434 precursor RNA comprises a plurality of segments, the first half of each such segment having a nucleotide sequence which is at least a partial inversed-reversed sequence of the second half thereof, as is well known in the art.

VGR434 folded precursor RNA, herein designated VGR FOLDED PRECURSOR RNA, is naturally processed by cellular enzymatic activity into at least 8 separate VGAM precursor RNAs, VGAM328 precursor RNA, VGAM329 precursor RNA, VGAM330 precursor RNA, VGAM331 precursor RNA, VGAM332 precursor RNA, VGAM333 precursor RNA, VGAM334 precursor RNA and VGAM335 precursor RNA, herein schematically represented by VGAM1 PRECURSOR, VGAM2 PRECURSOR, VGAM3 PRECURSOR, VGAM4 PRECURSOR, VGAM5 PRECURSOR, VGAM6 PRECURSOR, VGAM7 PRECURSOR and VGAM8 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM328 RNA, VGAM329 RNA, VGAM330 RNA, VGAM331 RNA, VGAM332 RNA, VGAM333 RNA, VGAM334 RNA and VGAM335 RNA respectively, herein schematically represented by VGAM1 RNA, VGAM2 RNA, VGAM3 RNA, VGAM4 RNA, VGAM5 RNA, VGAM6 RNA, VGAM7 RNA and VGAM8 RNA respectively, each of which VGAM RNAs corresponding to VGAM RNA of FIG. 8.

VGAM328 RNA, herein schematically represented by VGAM1 binds complimentarily to a host target binding site located in an untranslated region of VGAM328 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM328 host target RNA, herein schematically represented by VGAM1 HOST TARGET RNA into VGAM328 host target protein, herein schematically represented by VGAM1 HOST TARGET PROTEIN, both of FIG. 1.

VGAM329 RNA, herein schematically represented by VGAM2 binds complimentarily to a host target binding site located in an untranslated region of VGAM329 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM329 host target RNA, herein schematically represented by VGAM2 HOST TARGET RNA into VGAM329 host target protein, herein schematically represented by VGAM2 HOST TARGET PROTEIN, both of FIG. 1.

VGAM330 RNA, herein schematically represented by VGAM3 binds complimentarily to a host target binding site located in an untranslated region of VGAM330 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM330 host target RNA, herein schematically represented by VGAM3 HOST TARGET RNA into VGAM330 host target protein, herein schematically represented by VGAM3 HOST TARGET PROTEIN, both of FIG. 1.

VGAM331 RNA, herein schematically represented by VGAM4 binds complimentarily to a host target binding site located in an untranslated region of VGAM331 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM331 host target RNA, herein schematically represented by VGAM4 HOST TARGET RNA into VGAM331 host target protein, herein schematically represented by VGAM4 HOST TARGET PROTEIN, both of FIG. 1.

VGAM332 RNA, herein schematically represented by VGAM5 binds complimentarily to a host target binding site located in an untranslated region of VGAM332 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM332 host target RNA, herein schematically represented by VGAM5 HOST TARGET RNA into VGAM332 host target protein, herein schematically represented by VGAM5 HOST TARGET PROTEIN, both of FIG. 1.

VGAM333 RNA, herein schematically represented by VGAM6 binds complimentarily to a host target binding site located in an untranslated region of VGAM333 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM333 host target RNA, herein schematically represented by VGAM6 HOST TARGET RNA into VGAM333 host target protein, herein schematically represented by VGAM6 HOST TARGET PROTEIN, both of FIG. 1.

VGAM334 RNA, herein schematically represented by VGAM7 binds complimentarily to a host target binding site located in an untranslated region of VGAM334 host target RNA, herein schematically represented by VGAM7 HOST TARGET RNA, which host target binding site corresponds to a host target binding site such as BINDING SITE I, BINDING SITE II or BINDING SITE III of FIG. 1, thereby inhibiting translation of VGAM334 host target RNA, herein schematically represented by VGAM7 HOST TARGET RNA into VGAM334 host target protein, herein schematically represented by VGAM7 HOST TARGET PROTEIN, both of FIG. 1.

VGAM335 RNA, herein schematically represented by VGAM8 binds complimentarily to a host target binding site located in an untranslated region of VGAM335 host target RNA, herein schematically represented by VGAM8 HOST TARGET RNA, which host target binding site corresponds to a host target binding site such as BINDING SITE I, BINDING SITE II or BINDING SITE III of FIG. 1, thereby inhibiting translation of VGAM335 host target RNA, herein schematically represented by VGAM8 HOST TARGET RNA into VGAM335 host target protein, herein schematically represented by VGAM8 HOST TARGET PROTEIN, both of FIG. 1.

It is appreciated that a function of VGR434 gene, herein designated VGR GENE, is inhibition of expression of host target genes, as part of a novel viral mechanism of attacking a host. Accordingly, utilities of VGR434 gene include diagnosis, prevention and treatment of viral infection by. Specific functions, and accordingly utilities, of VGR434 gene, herein designated VGR GENE, correlate with, and may be deduced from, the identity of the host target genes, which are inhibited by VGAM RNAs comprised in the operon-like cluster of VGR434 gene: VGAM328 host target protein, VGAM329 host target protein, VGAM330 host target protein, VGAM331 host target protein, VGAM332 host target protein, VGAM333 host target protein, VGAM334 host target protein and VGAM335 host target protein, herein schematically represented by VGAM1 HOST TARGET PROTEIN through VGAM HOST TARGET PROTEIN respectively. The function of these host target genes is elaborated hereinabove with reference to VGAM328, VGAM329, VGAM330, VGAM331, VGAM332, VGAM333, VGAM334 and VGAM335

FIG. 9 further provides a conceptual description of novel bioinformatically detected regulatory viral gene, referred to here as Viral Genomic Record 435(VGR435) viral gene, which encodes an operon-like cluster of novel viral micro RNA-like genes, each of which in turn modulates expression of at least one host target gene, the function and utility of which at least one host target gene is known in the art.

VGR435 gene, herein designated VGR GENE, is a novel bioinformatically detected regulatory, non protein coding, RNA viral gene. The method by which VGR435 gene was detected is described hereinabove with reference to FIGS. 6-15.

VGR435 gene encodes VGR435 precursor RNA, herein designated VGR PRECURSOR RNA, an RNA molecule, typically several hundred nucleotides long.

VGR435 precursor RNA folds spatially, forming VGR435 folded precursor RNA, herein designated VGR FOLDED PRECURSOR RNA. It is appreciated that VGR435 folded precursor RNA, herein designated VGR FOLDED PRECURSOR RNA, comprises a plurality of what is known in the art as hairpin structures. These hairpin structures are due to the fact that the nucleotide sequence of VGR435 precursor RNA comprises a plurality of segments, the first half of each such segment having a nucleotide sequence which is at least a partial inversed-reversed sequence of the second half thereof, as is well known in the art.

VGR435 folded precursor RNA, herein designated VGR FOLDED PRECURSOR RNA, is naturally processed by cellular enzymatic activity into at least 5 separate VGAM precursor RNAs, VGAM336 precursor RNA, VGAM337 precursor RNA, VGAM338 precursor RNA, VGAM339 precursor RNA and VGAM340 precursor RNA, herein schematically represented by VGAM1 PRECURSOR, VGAM2 PRECURSOR, VGAM3 PRECURSOR, VGAM4 PRECURSOR and VGAM5 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM336 RNA, VGAM337 RNA, VGAM338 RNA, VGAM339 RNA and VGAM340 RNA respectively, herein schematically represented by VGAM1 RNA, VGAM2 RNA, VGAM3 RNA, VGAM4 RNA and VGAM5 RNA respectively, each of which VGAM RNAs corresponding to VGAM RNA of FIG. 8.

VGAM336 RNA, herein schematically represented by VGAM1 binds complimentarily to a host target binding site located in an untranslated region of VGAM336 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM336 host target RNA, herein schematically represented by VGAM1 HOST TARGET RNA into VGAM336 host target protein, herein schematically represented by VGAM1 HOST TARGET PROTEIN, both of FIG. 1.

VGAM337 RNA, herein schematically represented by VGAM2 binds complimentarily to a host target binding site located in an untranslated region of VGAM337 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM337 host target RNA, herein schematically represented by VGAM2 HOST TARGET RNA into VGAM337 host target protein, herein schematically represented by VGAM2 HOST TARGET PROTEIN, both of FIG. 1.

VGAM338 RNA, herein schematically represented by VGAM3 binds complimentarily to a host target binding site located in an untranslated region of VGAM338 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM338 host target RNA, herein schematically represented by VGAM3 HOST TARGET RNA into VGAM338 host target protein, herein schematically represented by VGAM3 HOST TARGET PROTEIN, both of FIG. 1.

VGAM339 RNA, herein schematically represented by VGAM4 binds complimentarily to a host target binding site located in an untranslated region of VGAM339 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM339 host target RNA, herein schematically represented by VGAM4 HOST TARGET RNA into VGAM339 host target protein, herein schematically represented by VGAM4 HOST TARGET PROTEIN, both of FIG. 1.

VGAM340 RNA, herein schematically represented by VGAM5 binds complimentarily to a host target binding site located in an untranslated region of VGAM340 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM340 host target RNA, herein schematically represented by VGAM5 HOST TARGET RNA into VGAM340 host target protein, herein schematically represented by VGAM5 HOST TARGET PROTEIN, both of FIG. 1.

It is appreciated that a function of VGR435 gene, herein designated VGR GENE, is inhibition of expression of host target genes, as part of a novel viral mechanism of attacking a host. Accordingly, utilities of VGR435 gene include diagnosis, prevention and treatment of viral infection by. Specific functions, and accordingly utilities, of VGR435 gene, herein designated VGR GENE, correlate with, and may be deduced from, the identity of the host target genes, which are inhibited by VGAM RNAs comprised in the operon-like cluster of VGR435 gene: VGAM336 host target protein, VGAM337 host target protein, VGAM338 host target protein, VGAM339 host target protein and VGAM340 host target protein, herein schematically represented by VGAM1 HOST TARGET PROTEIN through VGAM HOST TARGET PROTEIN respectively. The function of these host target genes is elaborated hereinabove with reference to VGAM336, VGAM337, VGAM338, VGAM339 and VGAM340

FIG. 9 further provides a conceptual description of novel bioinformatically detected regulatory viral gene, referred to here as Viral Genomic Record 436(VGR436) viral gene, which encodes an operon-like cluster of novel viral micro RNA-like genes, each of which in turn modulates expression of at least one host target gene, the function and utility of which at least one host target gene is known in the art.

VGR436 gene, herein designated VGR GENE, is a novel bioinformatically detected regulatory, non protein coding, RNA viral gene. The method by which VGR436 gene was detected is described hereinabove with reference to FIGS. 6-15.

VGR436 gene encodes VGR436 precursor RNA, herein designated VGR PRECURSOR RNA, an RNA molecule, typically several hundred nucleotides long.

VGR436 precursor RNA folds spatially, forming VGR436 folded precursor RNA, herein designated VGR FOLDED PRECURSOR RNA. It is appreciated that VGR436 folded precursor RNA, herein designated VGR FOLDED PRECURSOR RNA, comprises a plurality of what is known in the art as hairpin structures. These hairpin structures are due to the fact that the nucleotide sequence of VGR436 precursor RNA comprises a plurality of segments, the first half of each such segment having a nucleotide sequence which is at least a partial inversed-reversed sequence of the second half thereof, as is well known in the art.

VGR436 folded precursor RNA, herein designated VGR FOLDED PRECURSOR RNA, is naturally processed by cellular enzymatic activity into at least 7 separate VGAM precursor RNAs, VGAM341 precursor RNA, VGAM342 precursor RNA, VGAM343 precursor RNA, VGAM344 precursor RNA, VGAM345 precursor RNA, VGAM346 precursor RNA and VGAM347 precursor RNA, herein schematically represented by VGAM1 PRECURSOR, VGAM2 PRECURSOR, VGAM3 PRECURSOR, VGAM4 PRECURSOR, VGAM5 PRECURSOR, VGAM6 PRECURSOR and VGAM7 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM341 RNA, VGAM342 RNA, VGAM343 RNA, VGAM344 RNA, VGAM345 RNA, VGAM346 RNA and VGAM347 RNA respectively, herein schematically represented by VGAM1 RNA, VGAM2 RNA, VGAM3 RNA, VGAM4 RNA, VGAM5 RNA, VGAM6 RNA and VGAM7 RNA respectively, each of which VGAM RNAs corresponding to VGAM RNA of FIG. 8.

VGAM341 RNA, herein schematically represented by VGAM1 binds complimentarily to a host target binding site located in an untranslated region of VGAM341 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM341 host target RNA, herein schematically represented by VGAM1 HOST TARGET RNA into VGAM341 host target protein, herein schematically represented by VGAM1 HOST TARGET PROTEIN, both of FIG. 1.

VGAM342 RNA, herein schematically represented by VGAM2 binds complimentarily to a host target binding site located in an untranslated region of VGAM342 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM342 host target RNA, herein schematically represented by VGAM2 HOST TARGET RNA into VGAM342 host target protein, herein schematically represented by VGAM2 HOST TARGET PROTEIN, both of FIG. 1.

VGAM343 RNA, herein schematically represented by VGAM3 binds complimentarily to a host target binding site located in an untranslated region of VGAM343 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM343 host target RNA, herein schematically represented by VGAM3 HOST TARGET RNA into VGAM343 host target protein, herein schematically represented by VGAM3 HOST TARGET PROTEIN, both of FIG. 1.

VGAM344 RNA, herein schematically represented by VGAM4 binds complimentarily to a host target binding site located in an untranslated region of VGAM344 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM344 host target RNA, herein schematically represented by VGAM4 HOST TARGET RNA into VGAM344 host target protein, herein schematically represented by VGAM4 HOST TARGET PROTEIN, both of FIG. 1.

VGAM345 RNA, herein schematically represented by VGAM5 binds complimentarily to a host target binding site located in an untranslated region of VGAM345 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM345 host target RNA, herein schematically represented by VGAM5 HOST TARGET RNA into VGAM345 host target protein, herein schematically represented by VGAM5 HOST TARGET PROTEIN, both of FIG. 1.

VGAM346 RNA, herein schematically represented by VGAM6 binds complimentarily to a host target binding site located in an untranslated region of VGAM346 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM346 host target RNA, herein schematically represented by VGAM6 HOST TARGET RNA into VGAM346 host target protein, herein schematically represented by VGAM6 HOST TARGET PROTEIN, both of FIG. 1.

VGAM347 RNA, herein schematically represented by VGAM7 binds complimentarily to a host target binding site located in an untranslated region of VGAM347 host target RNA, herein schematically represented by VGAM7 HOST TARGET RNA, which host target binding site corresponds to a host target binding site such as BINDING SITE I, BINDING SITE II or BINDING SITE III of FIG. 1, thereby inhibiting translation of VGAM347 host target RNA, herein schematically represented by VGAM7 HOST TARGET RNA into VGAM347 host target protein, herein schematically represented by VGAM7 HOST TARGET PROTEIN, both of FIG. 1.

It is appreciated that a function of VGR436 gene, herein designated VGR GENE, is inhibition of expression of host target genes, as part of a novel viral mechanism of attacking a host. Accordingly, utilities of VGR436 gene include diagnosis, prevention and treatment of viral infection by. Specific functions, and accordingly utilities, of VGR436 gene, herein designated VGR GENE, correlate with, and may be deduced from, the identity of the host target genes, which are inhibited by VGAM RNAs comprised in the operon-like cluster of VGR436 gene: VGAM341 host target protein, VGAM342 host target protein, VGAM343 host target protein, VGAM344 host target protein, VGAM345 host target protein, VGAM346 host target protein and VGAM347 host target protein, herein schematically represented by VGAM1 HOST TARGET PROTEIN through VGAM HOST TARGET PROTEIN respectively. The function of these host target genes is elaborated hereinabove with reference to VGAM341, VGAM342, VGAM343, VGAM344, VGAM345, VGAM346 and VGAM347

FIG. 9 further provides a conceptual description of novel bioinformatically detected regulatory viral gene, referred to here as Viral Genomic Record 437(VGR437) viral gene, which encodes an operon-like cluster of novel viral micro RNA-like genes, each of which in turn modulates expression of at least one host target gene, the function and utility of which at least one host target gene is known in the art.

VGR437 gene, herein designated VGR GENE, is a novel bioinformatically detected regulatory, non protein coding, RNA viral gene. The method by which VGR437 gene was detected is described hereinabove with reference to FIGS. 6-15.

VGR437 gene encodes VGR437 precursor RNA, herein designated VGR PRECURSOR RNA, an RNA molecule, typically several hundred nucleotides long.

VGR437 precursor RNA folds spatially, forming VGR437 folded precursor RNA, herein designated VGR FOLDED PRECURSOR RNA. It is appreciated that VGR437 folded precursor RNA, herein designated VGR FOLDED PRECURSOR RNA, comprises a plurality of what is known in the art as hairpin structures. These hairpin structures are due to the fact that the nucleotide sequence of VGR437 precursor RNA comprises a plurality of segments, the first half of each such segment having a nucleotide sequence which is at least a partial inversed-reversed sequence of the second half thereof, as is well known in the art.

VGR437 folded precursor RNA, herein designated VGR FOLDED PRECURSOR RNA, is naturally processed by cellular enzymatic activity into at least 8 separate VGAM precursor RNAs, VGAM348 precursor RNA, VGAM349 precursor RNA, VGAM350 precursor RNA, VGAM351 precursor RNA, VGAM352 precursor RNA, VGAM353 precursor RNA, VGAM354 precursor RNA and VGAM355 precursor RNA, herein schematically represented by VGAM1 PRECURSOR, VGAM2 PRECURSOR, VGAM3 PRECURSOR, VGAM4 PRECURSOR, VGAM5 PRECURSOR, VGAM6 PRECURSOR, VGAM7 PRECURSOR and VGAM8 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM348 RNA, VGAM349 RNA, VGAM350 RNA, VGAM351 RNA, VGAM352 RNA, VGAM353 RNA, VGAM354 RNA and VGAM355 RNA respectively, herein schematically represented by VGAM1 RNA, VGAM2 RNA, VGAM3 RNA, VGAM4 RNA, VGAM5 RNA, VGAM6 RNA, VGAM7 RNA and VGAM8 RNA respectively, each of which VGAM RNAs corresponding to VGAM RNA of FIG. 8.

VGAM348 RNA, herein schematically represented by VGAM1 binds complimentarily to a host target binding site located in an untranslated region of VGAM348 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM348 host target RNA, herein schematically represented by VGAM1 HOST TARGET RNA into VGAM348 host target protein, herein schematically represented by VGAM1 HOST TARGET PROTEIN, both of FIG. 1.

VGAM349 RNA, herein schematically represented by VGAM2 binds complimentarily to a host target binding site located in an untranslated region of VGAM349 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM349 host target RNA, herein schematically represented by VGAM2 HOST TARGET RNA into VGAM349 host target protein, herein schematically represented by VGAM2 HOST TARGET PROTEIN, both of FIG. 1.

VGAM350 RNA, herein schematically represented by VGAM3 binds complimentarily to a host target binding site located in an untranslated region of VGAM350 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM350 host target RNA, herein schematically represented by VGAM3 HOST TARGET RNA into VGAM350 host target protein, herein schematically represented by VGAM3 HOST TARGET PROTEIN, both of FIG. 1.

VGAM351 RNA, herein schematically represented by VGAM4 binds complimentarily to a host target binding site located in an untranslated region of VGAM351 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM351 host target RNA, herein schematically represented by VGAM4 HOST TARGET RNA into VGAM351 host target protein, herein schematically represented by VGAM4 HOST TARGET PROTEIN, both of FIG. 1.

VGAM352 RNA, herein schematically represented by VGAM5 binds complimentarily to a host target binding site located in an untranslated region of VGAM352 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM352 host target RNA, herein schematically represented by VGAM5 HOST TARGET RNA into VGAM352 host target protein, herein schematically represented by VGAM5 HOST TARGET PROTEIN, both of FIG. 1.

VGAM353 RNA, herein schematically represented by VGAM6 binds complimentarily to a host target binding site located in an untranslated region of VGAM353 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM353 host target RNA, herein schematically represented by VGAM6 HOST TARGET RNA into VGAM353 host target protein, herein schematically represented by VGAM6 HOST TARGET PROTEIN, both of FIG. 1.

VGAM354 RNA, herein schematically represented by VGAM7 binds complimentarily to a host target binding site located in an untranslated region of VGAM354 host target RNA, herein schematically represented by VGAM7 HOST TARGET RNA, which host target binding site corresponds to a host target binding site such as BINDING SITE I, BINDING SITE II or BINDING SITE III of FIG. 1, thereby inhibiting translation of VGAM354 host target RNA, herein schematically represented by VGAM7 HOST TARGET RNA into VGAM354 host target protein, herein schematically represented by VGAM7 HOST TARGET PROTEIN, both of FIG. 1.

VGAM355 RNA, herein schematically represented by VGAM8 binds complimentarily to a host target binding site located in an untranslated region of VGAM355 host target RNA, herein schematically represented by VGAM8 HOST TARGET RNA, which host target binding site corresponds to a host target binding site such as BINDING SITE I, BINDING SITE II or BINDING SITE III of FIG. 1, thereby inhibiting translation of VGAM355 host target RNA, herein schematically represented by VGAM8 HOST TARGET RNA into VGAM355 host target protein, herein schematically represented by VGAM8 HOST TARGET PROTEIN, both of FIG. 1.

It is appreciated that a function of VGR437 gene, herein designated VGR GENE, is inhibition of expression of host target genes, as part of a novel viral mechanism of attacking a host. Accordingly, utilities of VGR437 gene include diagnosis, prevention and treatment of viral infection by. Specific functions, and accordingly utilities, of VGR437 gene, herein designated VGR GENE, correlate with, and may be deduced from, the identity of the host target genes, which are inhibited by VGAM RNAs comprised in the operon-like cluster of VGR437 gene: VGAM348 host target protein, VGAM349 host target protein, VGAM350 host target protein, VGAM351 host target protein, VGAM352 host target protein, VGAM353 host target protein, VGAM354 host target protein and VGAM355 host target protein, herein schematically represented by VGAM1 HOST TARGET PROTEIN through VGAM HOST TARGET PROTEIN respectively. The function of these host target genes is elaborated hereinabove with reference to VGAM348, VGAM349, VGAM350, VGAM351, VGAM352, VGAM353, VGAM354 and VGAM355

FIG. 9 further provides a conceptual description of novel bioinformatically detected regulatory viral gene, referred to here as Viral Genomic Record 438(VGR438) viral gene, which encodes an operon-like cluster of novel viral micro RNA-like genes, each of which in turn modulates expression of at least one host target gene, the function and utility of which at least one host target gene is known in the art.

VGR438 gene, herein designated VGR GENE, is a novel bioinformatically detected regulatory, non protein coding, RNA viral gene. The method by which VGR438 gene was detected is described hereinabove with reference to FIGS. 6-15.

VGR438 gene encodes VGR438 precursor RNA, herein designated VGR PRECURSOR RNA, an RNA molecule, typically several hundred nucleotides long.

VGR438 precursor RNA folds spatially, forming VGR438 folded precursor RNA, herein designated VGR FOLDED PRECURSOR RNA. It is appreciated that VGR438 folded precursor RNA, herein designated VGR FOLDED PRECURSOR RNA, comprises a plurality of what is known in the art as hairpin structures. These hairpin structures are due to the fact that the nucleotide sequence of VGR438 precursor RNA comprises a plurality of segments, the first half of each such segment having a nucleotide sequence which is at least a partial inversed-reversed sequence of the second half thereof, as is well known in the art.

VGR438 folded precursor RNA, herein designated VGR FOLDED PRECURSOR RNA, is naturally processed by cellular enzymatic activity into at least 2 separate VGAM precursor RNAs, VGAM356 precursor RNA and VGAM357 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM356 RNA and VGAM357 RNA respectively, herein schematically represented by VGAM1 RNA and VGAM2 RNA respectively, each of which VGAM RNAs corresponding to VGAM RNA of FIG. 8.

VGAM356 RNA, herein schematically represented by VGAM1 binds complimentarily to a host target binding site located in an untranslated region of VGAM356 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM356 host target RNA, herein schematically represented by VGAM1 HOST TARGET RNA into VGAM356 host target protein, herein schematically represented by VGAM1 HOST TARGET PROTEIN, both of FIG. 1.

VGAM357 RNA, herein schematically represented by VGAM2 binds complimentarily to a host target binding site located in an untranslated region of VGAM357 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM357 host target RNA, herein schematically represented by VGAM2 HOST TARGET RNA into VGAM357 host target protein, herein schematically represented by VGAM2 HOST TARGET PROTEIN, both of FIG. 1.

It is appreciated that a function of VGR438 gene, herein designated VGR GENE, is inhibition of expression of host target genes, as part of a novel viral mechanism of attacking a host. Accordingly, utilities of VGR438 gene include diagnosis, prevention and treatment of viral infection by. Specific functions, and accordingly utilities, of VGR438 gene, herein designated VGR GENE, correlate with, and may be deduced from, the identity of the host target genes, which are inhibited by VGAM RNAs comprised in the operon-like cluster of VGR438 gene: VGAM356 host target protein and VGAM357 host target protein, herein schematically represented by VGAM1 HOST TARGET PROTEIN and VGAM HOST TARGET PROTEIN respectively. The function of these host target genes is elaborated hereinabove with reference to VGAM356 and VGAM357

FIG. 9 further provides a conceptual description of novel bioinformatically detected regulatory viral gene, referred to here as Viral Genomic Record 439(VGR439) viral gene, which encodes an operon-like cluster of novel viral micro RNA-like genes, each of which in turn modulates expression of at least one host target gene, the function and utility of which at least one host target gene is known in the art.

VGR439 gene, herein designated VGR GENE, is a novel bioinformatically detected regulatory, non protein coding, RNA viral gene. The method by which VGR439 gene was detected is described hereinabove with reference to FIGS. 6-15.

VGR439 gene encodes VGR439 precursor RNA, herein designated VGR PRECURSOR RNA, an RNA molecule, typically several hundred nucleotides long.

VGR439 precursor RNA folds spatially, forming VGR439 folded precursor RNA, herein designated VGR FOLDED PRECURSOR RNA. It is appreciated that VGR439 folded precursor RNA, herein designated VGR FOLDED PRECURSOR RNA, comprises a plurality of what is known in the art as hairpin structures. These hairpin structures are due to the fact that the nucleotide sequence of VGR439 precursor RNA comprises a plurality of segments, the first half of each such segment having a nucleotide sequence which is at least a partial inversed-reversed sequence of the second half thereof, as is well known in the art.

VGR439 folded precursor RNA, herein designated VGR FOLDED PRECURSOR RNA, is naturally processed by cellular enzymatic activity into at least 2 separate VGAM precursor RNAs, VGAM358 precursor RNA and VGAM359 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM358 RNA and VGAM359 RNA respectively, herein schematically represented by VGAM1 RNA and VGAM2 RNA respectively, each of which VGAM RNAs corresponding to VGAM RNA of FIG. 8.

VGAM358 RNA, herein schematically represented by VGAM1 binds complimentarily to a host target binding site located in an untranslated region of VGAM358 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM358 host target RNA, herein schematically represented by VGAM1 HOST TARGET RNA into VGAM358 host target protein, herein schematically represented by VGAM1 HOST TARGET PROTEIN, both of FIG. 1.

VGAM359 RNA, herein schematically represented by VGAM2 binds complimentarily to a host target binding site located in an untranslated region of VGAM359 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM359 host target RNA, herein schematically represented by VGAM2 HOST TARGET RNA into VGAM359 host target protein, herein schematically represented by VGAM2 HOST TARGET PROTEIN, both of FIG. 1.

It is appreciated that a function of VGR439 gene, herein designated VGR GENE, is inhibition of expression of host target genes, as part of a novel viral mechanism of attacking a host. Accordingly, utilities of VGR439 gene include diagnosis, prevention and treatment of viral infection by. Specific functions, and accordingly utilities, of VGR439 gene, herein designated VGR GENE, correlate with, and may be deduced from, the identity of the host target genes, which are inhibited by VGAM RNAs comprised in the operon-like cluster of VGR439 gene: VGAM358 host target protein and VGAM359 host target protein, herein schematically represented by VGAM1 HOST TARGET PROTEIN and VGAM HOST TARGET PROTEIN respectively. The function of these host target genes is elaborated hereinabove with reference to VGAM358 and VGAM359

FIG. 9 further provides a conceptual description of novel bioinformatically detected regulatory viral gene, referred to here as Viral Genomic Record 440(VGR440) viral gene, which encodes an operon-like cluster of novel viral micro RNA-like genes, each of which in turn modulates expression of at least one host target gene, the function and utility of which at least one host target gene is known in the art.

VGR440 gene, herein designated VGR GENE, is a novel bioinformatically detected regulatory, non protein coding, RNA viral gene. The method by which VGR440 gene was detected is described hereinabove with reference to FIGS. 6-15.

VGR440 gene encodes VGR440 precursor RNA, herein designated VGR PRECURSOR RNA, an RNA molecule, typically several hundred nucleotides long.

VGR440 precursor RNA folds spatially, forming VGR440 folded precursor RNA, herein designated VGR FOLDED PRECURSOR RNA. It is appreciated that VGR440 folded precursor RNA, herein designated VGR FOLDED PRECURSOR RNA, comprises a plurality of what is known in the art as hairpin structures. These hairpin structures are due to the fact that the nucleotide sequence of VGR440 precursor RNA comprises a plurality of segments, the first half of each such segment having a nucleotide sequence which is at least a partial inversed-reversed sequence of the second half thereof, as is well known in the art.

VGR440 folded precursor RNA, herein designated VGR FOLDED PRECURSOR RNA, is naturally processed by cellular enzymatic activity into at least 2 separate VGAM precursor RNAs, VGAM361 precursor RNA and VGAM362 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM361 RNA and VGAM362 RNA respectively, herein schematically represented by VGAM1 RNA and VGAM2 RNA respectively, each of which VGAM RNAs corresponding to VGAM RNA of FIG. 8.

VGAM361 RNA, herein schematically represented by VGAM1 binds complimentarily to a host target binding site located in an untranslated region of VGAM361 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM361 host target RNA, herein schematically represented by VGAM1 HOST TARGET RNA into VGAM361 host target protein, herein schematically represented by VGAM1 HOST TARGET PROTEIN, both of FIG. 1.

VGAM362 RNA, herein schematically represented by VGAM2 binds complimentarily to a host target binding site located in an untranslated region of VGAM362 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM362 host target RNA, herein schematically represented by VGAM2 HOST TARGET RNA into VGAM362 host target protein, herein schematically represented by VGAM2 HOST TARGET PROTEIN, both of FIG. 1.

It is appreciated that a function of VGR440 gene, herein designated VGR GENE, is inhibition of expression of host target genes, as part of a novel viral mechanism of attacking a host. Accordingly, utilities of VGR440 gene include diagnosis, prevention and treatment of viral infection by. Specific functions, and accordingly utilities, of VGR440 gene, herein designated VGR GENE, correlate with, and may be deduced from, the identity of the host target genes, which are inhibited by VGAM RNAs comprised in the operon-like cluster of VGR440 gene: VGAM361 host target protein and VGAM362 host target protein, herein schematically represented by VGAM1 HOST TARGET PROTEIN and VGAM HOST TARGET PROTEIN respectively. The function of these host target genes is elaborated hereinabove with reference to VGAM361 and VGAM362

BIBLIOGRAPHY

It is appreciated by persons skilled in the art that the present invention is not limited by what has been particularly shown and described hereinabove. Rather the scope of the present invention includes both combinations and subcombinations of the various features described hereinabove as well as variations and modifications which would occur to persons skilled in the art upon reading the specifications and which are not in the prior art.

1. Zuker, C. S.: On the evolution of eyes: would you like it simple or compound? Science 265: 742-743, 1994.
2. Fishman, G. I.; Moreno, A. P.; Spray, D. C.; Leinwand, L. A.: Functional analysis of human cardiac gap junction channel mutants. Proc. Nat. Acad. Sci. 88: 3525-3529, 1991.
3. Yamauchi, M.; Yamauchi, N.; Meuth, M.: Molecular cloning of the human CTP synthetase gene by functional complementation with purified human metaphase chromosomes. EMBO J. 9: 2095-2099, 1990.
4. Vestergaard, P.; Hermann, A. P.; Orskov, H.; Mosekilde, L.; The Danish Osteoporosis Prevention Study: Effect of sex hormone replacement on the insulin-like growth factor system and bone mineral: a cross-sectional and longitudinal study in 595 perimenopausal women participating in the Danish osteoporosis prevention study. J. Clin. Endocr. Metab. 84:2286-2290, 1999.
5. Shozu, M.; Akasofu, K.; Harada, T.; Kubota, Y.: A new cause of female pseudohermaphroditism: placental aromatase deficiency. J. Clin. Endocr. Metab. 72: 560-566, 1991.
6. Gorn, A. H.; Rudolph, S. M.; Flannery, M. R.; Morton, C. C.; Weremowicz, S.; Wang, J.-T.; Krane, S. M.; Goldring, S. R.: Expression of two human skeletal calcitonin receptor isoforms cloned from a giant cell tumor of bone. J. Clin. Invest. 95: 2680-2691, 1995.
7. Bonaiti-Pellie, C.; Briard-Guillemot, M. L.; Feingold, J.; Frezal, J.: Associated congenital malformations in retinoblastoma. Clin. Genet. 7: 37-39, 1975.
8. Bookstein, R.; Lee, E. Y.-H. P.; To, H.; Young, L.-J.; Sery, T. W.; Hayes, R. C.; Friedmann, T.; Lee, W.-H.: Human retinoblastoma susceptibility gene: genomic organization and analysis of heterozygous intragenic deletion mutants. Proc. Nat. Acad. Sci. 85: 2210-2214, 1988.
9. Brantley, M. A.; Worley, L.; Harbour, J. W.: Altered expression of Rb and p53 in uveal melanomas following plaque radiotherapy. Am. J. Ophthal. 133: 242-248, 2002.
10. Bremner, R.; Du, D. C.; Connolly-Wilson, M. J.; Bridge, P.; Ahmad, K. F.; Mostachfi, H.; Rushlow, D.; Dunn, J. M.; Gallie, B. L.: Deletion of RB exons 24 and 25 causes low-penetrance retinoblastoma. Am. J. Hum. Genet. 61: 556-570, 1997.
11. Briard-Guillemot, M. L.; Bonaiti-Pellie, C.; Feingold, J.; Frezal, J.: Etude genetique du retinoblastome. Humangenetik 24: 271-284, 1974.
12. Brownstein, S.; de Chadarevian, J.-P.; Little, J. M.: Trilateral retinoblastoma: report of two cases. Arch. Ophthal. 102: 257-262, 1984.
13. Buchkovich, K.; Duffy, L. A.; Harlow, E.: The retinoblastoma protein is phosphorylated during specific phases of the cell cycle. Cell 58:1097-1105, 1989.
14. Lohr, G. W.; Waller, H. D.: Zur Biochemie einiger angeborenerhaemolytischer Anaemien. Folia Haemat. 8: 377-397, 1963.
15. Erneux, C.; Roeckel, N.; Takazawa, K.; Mailleux, P.; Vassart, G.; Mattei, M. G.: Localization of the genes for human inositol 1,4,5-trisphosphate3-kinase A (ITPKA) and B (ITPKB) to chromosome regions 15q-14-q21 and 1q41-q43, respectively, by in situ hybridization. Genomics 14:546-547, 1992.
16. Takazawa, K.; Perret, J.; Dumont, J. E.; Erneux, C.: Molecular cloning and expression of a new putative inositol 1,4,5-trisphosphate3-kinase isoenzyme. Biochem. J. 278: 883-886, 1991.
17. Bohni, R.; Riesgo-Escovar, J.; Oldham, S.; Brogiolo, W.; Stocker, H.; Andruss, B. F.; Beckingham, K.; Hafen, E.: Autonomous control of cell and organ size by CHICO, a Drosophila homolog of vertebrate IRS1-4. Cell 97: 865-875, 1999.
18. Fletcher, W. H.; Britz-Cunningham, S. H.; Zuppan, C. W.: Connexin 43 mutations in sporadic and familial defects of laterality. (Letter) New Eng. J. Med. 333: 941-942, 1995.
19. Gebbia, M.; Towbin, J. A.; Casey, B.: Failure to detect connexin 43 mutations in 38 cases of sporadic and familial heterotaxy. Circulation 94:1909-1912, 1996.
20. Gebbia, M.; Towbin, J. A.; Casey, B.: Connexin 43 gene mutations and heterotaxy. Response. (Letter) Circulation 97: 118 only, 1998.
21. Guerrero, P. A.; Schuessler, R. B.; Davis, L. M.; Beyer, E. C.; Johnson, C. M.; Yamada, K. A.; Saffitz, J. E.: Slow ventricular conduction in mice heterozygous for a connexin 43 null mutation. J. Clin. Invest. 99:1991-1998, 1997.
22. Li, J.-Y.; Hou, X.-E.; Dahlstrom, A.: GAP-43 and its relation to autonomic and sensory neurons in sciatic nerve and gastrocnemiusmuscle in the rat. J. Auton. Nerv. Syst. 50: 299-309, 1995.
23. Liao, Y.; Day, K. H.; Damon, D. N.; Duling, B. R.: Endothelial cell-specific knockout of connexin 43 causes hypotension and bradycardia in mice. Proc. Nat. Acad. Sci. 98: 9989-9994, 2001.
24. Liu, X. Z.; Xia, X. J.; Adams, J.; Chen, Z. Y.; Welch, K. O.; Tekin, M.; Ouyang, X. M.; Kristiansen, A.; Pandya, A.; Balkany, T.; Arnos, K. S.; Nance, W. E.: Mutations in GJA1 (connexin 43) are associated with non-syndromic autosomal recessive deafness. Hum. Molec. Genet. 10:2945-2951, 2001.
25. Reaume, A. G.; de Sousa, P. A.; Kulkarni, S.; Langille, B. L.; Zhu, D.; Davies, T. C.; Juneja, S. C.; Kidder, G. M.; Rossant, J.: Cardiac malformation in neonatal mice lacking connexin 43. Science 267:1831-1834, 1995.
26. Splitt, M. P.; Burn, J.; Goodship, J.: Connexin 43 mutations insporadic and familial defects of laterality. (Letter) New Eng. J. Med. 333: 941, 1995.
27. Splitt, M. P.; Tsai, M. Y.; Burn, J.; Goodship, J. A.: Absence of mutations in the regulatory domain of the gap junction protein connexin 43 in patients with visceroatrial heterotaxy. Heart 77:369-370, 1997.
28. Toth, T.; Hajdu, J.; Marton, T.; Nagy, B.; Papp, Z.: Connexin 43 gene mutations and heterotaxy. (Letter) Circulation 97: 117-118, 1998.
29. Ya, J.; Erdstieck-Ernste, E. B. H. W.; de Boer, P. A. J.; van Kempen, M. J. A.; Jongsma, H.; Gros, D.; Moorman, A. F. M.; Lamers, W. H.: Heart defects in connexin 43-deficient mice. Circ. Res. 82:360-366, 1998.
30. Harbour, J. W.; Luo, R. X.; Dei Santi, A.; Postigo, A. A.; Dean, D. C.: Cdk phosphorylation triggers sequential intramolecular interactions that progressively block Rb functions as cells move through G1. Cell 98:859-869, 1999.

31. Bullrich, F.; MacLachlan, T. K.; Sang, N.; Druck, T.; Veronese, M. L.; Allen, S. L.; Chiorazzi, N.; Koff, A.; Heubner, K.; Croce, C. M.; Giordano, A.: Chromosomal mapping of members of the cdc2 family of protein kinases, cdk3, cdk6, PISSLRE, and PITALRE, and a cdk inhibitor, p27-Kip1, to regions involved in human cancer. Cancer Res. 55: 1199-1205, 1995.

32. Abraham, J. A.; Mergia, A.; Whang, J. L.; Tumolo, A.; Friedman, J.; Hjerild, K. A.; Gospodarowicz, D.; Fiddes, J. C.: Nucleotide sequence of a bovine clone encoding the angiogenic protein, basic fibroblast growth factor. Science 233: 545-548, 1986.

33. Abraham, J. A.; Whang, J. L.; Tumolo, A.; Mergia, A.; Friedman, J.; Gospodarowicz, D.; Fiddes, J. C.: Human basic fibroblast growth factor: nucleotide sequence and genomic organization. EMBO J. 5:2523-2528, 1986.

34. Doniach, T.: Basic FGF as an inducer of anteroposterior neural pattern. Cell 83: 1067-1070, 1995.

35. Dono, R.; Texido, G.; Dussel, R.; Ehmke, H.; Zeller, R.: Impaired cerebral cortex development and blood pressure regulation in FGF2-deficient mice. EMBO J. 17: 4213-4225, 1998.

36. Fukushima, Y.; Byers, M. G.; Fiddes, J. C.; Shows, T. B.: The human basic fibroblast growth factor gene (FGFB) is assigned to chromosome 4q25. Cytogenet. Cell Genet. 54: 159-160, 1990.

37. Gritti, A.; Parati, E. A.; Cova, L.; Frolichsthal, P.; Galli, R.; Wanke, E.; Faravelli, L.; Morassutti, D. J.; Roisen, F.; Nickel, D. D.; Vescovi, A. L.: Multipotential stem cells from the adult mouse brain proliferate and self-renew in response to basic fibroblast growth factor. J. Neurosci. 16: 1091-1100, 1996.

38. Kawaguchi, H.; Nakamura, K.; Tabata, Y.; Ikada, Y.; Aoyama, I.; Anzai, J.; Nakamura, T.; Hiyama, Y.; Tamura, M.: Acceleration of fracture healing in nonhuman primates by fibroblast growth factor-2. J. Clin. Endocr. Metab. 86: 875-880, 2001.

39. Kurokawa, T.; Sasada, R.; Iwane, M.; Igarashi, K.: Cloning and expression of cDNA encoding human basic fibroblast growth factor. FEBS Lett. 213: 189-194, 1987.

40. Lafage-Pochitaloff, M.; Galland, F.; Simonetti, J.; Prats, H.; Mattei, M.-G.; Birnbaum, D.: The human basic fibroblast growth factor gene is located on the long arm of chromosome 4 at bands q26-q27. Oncogene Res. 5: 241-244, 1990.

41. Mattei, M.-G.; Pebusque, M.-J.; Birnbaum, D.: Chromosomal localizations of mouse Fgf2 and Fgf5 genes. Mammalian Genome 2: 135-137, 1992.

42. Montero, A.; Okada, Y.; Tomita, M.; Ito, M.; Tsurukami, H.; Nakamura, T.; Doetschman, T.; Coffin, J. D.; Hurley, M. M.: Disruption of the fibroblast growth factor-2 gene results in decreased bone mass and bone formation. J. Clin. Invest. 105: 1085-1093, 2000.

43. Ortega, S.; Ittmann, M.; Tsang, S. H.; Ehrlich, M.; Basilico, C.: Neuronal defects and delayed wound healing in mice lacking fibroblast growth factor 2. Proc. Nat. Acad. Sci. 95: 5672-5677, 1998.

44. Plotnikov, A. N.; Schlessinger, J.; Hubbard, S. R.; Mohammadi, M.: Structural basis for FGF receptor dimerization and activation. Cell 98:641-650, 1999.

45. Avraham, K. B.; Givol, D.; Avivi, A.; Yayon, A.; Copeland, N. G.; Jenkins, N. A.: Mapping of murine fibroblast growth factor receptors refines regions of homology between mouse and human chromosomes. Genomics 21:656-658, 1994.

46. Szepetowski, P.; Perucca-Lostanlen, D.; Gaudray, P.: Mapping genes according to their amplification status in tumor cells: contribution to the map of 11q13. Genomics 16: 745-750, 1993.

47. Schlossman, S. F.; Boumsell, L.; Gilks, W.; Harlan, J. M.; Kishimoto, T.; Morimoto, C.; Ritz, J.; Shaw, S.; Silverstein, R. L.; Springer, T. A.; Tedder, T. F.; Todd, R. F.: CD antigens 1993. Immun. Today 15:98-99, 1994.

48. Whitehouse, D. B.; Attwood, J.; Green, C.; Bruce, M.; McQuade, M.; Tippett, P.: Inheritance and linkage data for an unusual combination of genes (at the LKE, PI and C6 loci) in a single large sibship. Ann. Hum. Genet. 52: 197-201, 1988.

49. Daniels, G. L.; Le Pennec, P. Y.; Rouger, P.; Salmon, C.; Tippett, P.: The red cell antigens Au(a) and Au(b) belong to the Lutheran system. Vox Sang. 60: 191-192, 1991.

50. Campbell, I. G.; Foulkes, W. D.; Senger, G.; Trowsdale, J.; Garin-Chesa, P.; Rettig, W. J.: Molecular cloning of the B-CAM cell surface glycoprotein of epithelial cancers: a novel member of the immunoglobulin superfamily. Cancer Res. 54: 5761-5765, 1994.

51. Cook, P. J. L.: The Lutheran-secretor recombination fraction in man: a possible sex difference. Ann. Hum. Genet. 28: 393-401, 1965.

52. Higashiyama, S.; Lau, K.; Besner, G. E.; Abraham, J. A.; Klagsbrun, M.: Structure of heparin-binding EGF-like growth factor: multiple forms, primary structure, and glycosylation of the mature protein. J. Biol. Chem. 267: 6205-6212, 1992.

53. Naglich, J. G.; Metherall, J. E.; Russell, D. W.; Eidels, L.: Expression cloning of a diphtheria toxin receptor: identity with a heparin-binding EGF-like growth factor precursor. Cell 69: 1051-1061, 1992.

54. Pappenheimer, A. M., Jr.: Diphtheria toxin. Ann. Rev. Biochem. 46:69-94, 1977.

55. Pappenheimer, A. M., Jr.; Gill, D. M.: Diphtheria. Science 182:353-358, 1973.

56. Pathak, B. G.; Gilbert, D. J.; Harrison, C. A.; Luetteke, N. C.; Chen, X.; Klagsbrun, M.; Plowman, G. D.; Copeland, N. G.; Jenkins, N. A.; Lee, D. C.: Mouse chromosomal location of three EGF receptor ligands: amphiregulin (Areg), betacellulin (Btc), and heparin-binding EGF (Hegfl). Genomics 28: 116-118, 1995.

57. Roberts, M.; Ruddle, F. H.: The Chinese hamster gene map: assignment of four genes (DTS, PGM2, 6PGD, Eno1) to chromosome 2. Exp. Cell Res. 127: 47-54, 1980.

58. Keegan, K.; Johnson, D. E.; Williams, L. T.; Hayman, M. J.: Isolation of an additional member of the fibroblast growth factor receptor family, FGFR-3. Proc. Nat. Acad. Sci. 88: 1095-1099, 1991.

59. Jutel, M.; Watanabe, T.; Klunker, S.; Akdis, M.; Thomet, O. A. R.; Malolepszy, J.; Zak-Nejmark, T.; Koga, R.; Kobayashi, T.; Blaser, K.; Akdis, C. A.: Histamine regulates T-cell and antibody responses by differential expression of H1 and H2 receptors. Nature 413: 420-425, 2001.

60. Dixon, M. J.; Gazzard, J.; Chaudhry, S. S.; Sampson, N.; Schulte, B. A.; Steel, K. P.: Mutation of the Na—K—Cl co-transporter geneSlc12a2 results in deafness in mice. Hum. Molec. Genet. 8: 1579-1584, 1999.

61. Bora, N. S.; Lublin, D. M.; Kumar, B. V.; Hockett, R. D.; Holers, V. M.; Atkinson, J. P.: Structural gene for human membrane cofactor protein (MCP) of complement maps to within 100 kb of the 3-prime end of the C3b/C4b receptor gene. J. Exp. Med. 169: 597-602, 1989.

62. Cui, W.; Hourcade, D.; Post, T.; Greenlund, A. C.; Atkinson, J. P.; Kumar, V.: Characterization of the promoter region of the membrane cofactor protein (CD46) gene of the human complement system and comparison to a membrane cofactor protein-like genetic element. J. Immun. 151:4137-4146, 1993.
63. Dorig, R. E.; Marcil, A.; Chopra, A.; Richardson, C. D.: The human CD46 molecule is a receptor for measles virus (Edmonston strain). Cell 75:295-305, 1993.
64. Kallstrom, H.; Gill, D. B.; Albiger, B.; Liszewski, M. K.; Atkinson, J. P.; Jonsson, A.-B.: Attachment of Neisseria gonorrhoeae to the cellular pilus receptor CD46: identification of domains important for bacterial adherence. Cell. Microbiol. 3: 133-143, 2001.
65. Lublin, D. M.; Liszewski, M. K.; Post, T. W.; Arce, M. A.; LeBeau, M. M.; Rebentisch, M. B.; Lemons, R. S.; Seya, T.; Atkinson, J. P.: Molecular cloning and chromosomal localization of human complement membrane cofactor protein (MCP): evidence for inclusion in the multigene family of complement-regulatory proteins. J. Exp. Med. 168: 181-194, 1988.
66. Marie, J. C.; Astier, A. L.; Rivailler, P.; Rabourdin-Combe, C.; Wild, T. F.; Horvat, B.: Linking innate and acquired immunity: divergent role of CD46 cytoplasmic domains in T cell-induced inflammation. Nature Immun. 3: 659-666, 2002.
67. Post, T. W.; Liszewski, M. K.; Adams, E. M.; Tedja, I.; Miller, E. A.; Atkinson, J. P.: Membrane cofactor protein of the complement system: alternative splicing of serine/threonine/proline-rich exons and cytoplasmic tails produces multiple isoforms that correlate with protein phenotype. J. Exp. Med. 174: 93-102, 1991.
68. Purcell, D. F. J.; Johnstone, R. W.; McKenzie, I. F. C.: Identification of four different CD46 (MCP) molecules with anti-peptide antibodies. Biochem. Biophys. Res. Commun. 180: 1091-1097, 1991.
69. Santoro, F.; Kennedy, P. E.; Locatelli, G.; Malnati, M. S.; Berger, E. A.; Lusso, P.: CD46 is a cellular receptor for human herpesvirus 6. Cell 99: 817-827, 1999.
70. Tatsuo, H.; Ono, N.; Tanaka, K.; Yanagi, Y.: SLAM (CDw150) is a cellular receptor for measles virus. Nature 406: 893-897, 2000.
71. Kramer, A.; Yang, F.-C.; Snodgrass, P.; Li, X.; Scammell, T. E.; Davis, F. C.; Weitz, C. J.: Regulation of daily locomotor activity and sleep by hypothalamic EGF receptor signaling. Science 294: 2511-2515, 2001.
72. Lanzetti, L.; Rybin, V.; Malabarba, M. G.; Christoforidis, S.; Scita, G.; Zerial, M.; Di Fiore, P. P.: The Eps8 protein coordinates EGF receptor signalling through Rac and trafficking through Rab5. Nature 408:374-377, 2000.
73. Volpert, O. V.; Zaichuk, T.; Zhou, W.; Reiher, F.; Ferguson, T. A.; Stuart, P. M.; Amin, M.; Bouck, N. P.: Inducer-stimulated Fastargets activated endothelium for destruction by anti-angiogenic thrombospondin-1 and pigment epithelium-derived factor. Nature Med. 8: 349-357, 2002.
74. Yang, J.; Patil, R. V.; Yu, H.; Gordon, M.; Wax, M. B.: T cell subsets and sIL-2R/IL-2 levels in patients with glaucoma. Am. J. Ophthal. 131: 421-426, 2001.
75. Cenciarelli, C.; Chiaur, D. S.; Guardavaccaro, D.; Parks, W.; Vidal, M.; Pagano, M.: Identification of a family of human F-box proteins. Curr. Biol. 9: 1177-1179, 1999.
76. Winston, J. T.; Koepp, D. M.; Zhu, C.; Elledge, S. J.; Harper, J. W.: A family of mammalian F-box proteins. Curr. Biol. 9: 1180-1182, 1999.
77. Mullis, P. E.; Patel, M. S.; Brickell, P. M.; Hindmarsh, P. C.; Brook, C. G. D.: Growth characteristics and response to growth hormone therapy in patients with hypochondroplasia: genetic linkage of the insulin-like growth factor I gene at chromosome 12q23 to the disease in a subgroup of these patients. Clin. Endocr. 34: 265-274, 1991.
78. Delespesse, G.; Sarfati, M.; Peleman, R.: Influence of recombinant IL-4, IFN-alpha, and IFN-gamma on the production of human IgE-binding factor (soluble CD23). J. Immun. 142: 134-138, 1989.
79. Ludin, C.; Hofstetter, H.; Sarfati, M.; Levy, C. A.; Suter, U.; Alaimo, D.; Kilchherr, E.; Frost, H.; Delespesse, G.: Cloning and expression of the cDNA coding for a human lymphocyte IgE receptor. EMBO J. 6: 109-114, 1987.
80. Wendel-Hansen, V.; Riviere, M.; Uno, M.; Jansson, I.; Szpirer, J.; Islam, M. Q.; Levan, G.; Klein, G.; Yodoi, J.; Rosen, A.; Szpirer, C.: The gene encoding CD23 leukocyte antigen (FCE2) is located on human chromosome 19. Somat. Cell Molec. Genet. 16: 283-286, 1990.
81. Lai, L.; Hart, I.; Patterson, D.: Human chromosome 1 corrects the defect in the CHO mutant (Ade-H) deficient in a branch point enzyme in purine de novo biosynthesis. (Abstract) Cytogenet. Cell Genet. 51:1028 only, 1989.
82. Lai, L.-W.; Hart, I. M.; Patterson, D.: A gene correcting the defect in the CHO mutant Ade(−)H, deficient in a branch point enzyme (adenylosuccinate synthetase) of de novo purine biosynthesis, is located on the long arm of chromosome 1. Genomics 9: 322-328, 1991.
83. Powell, S. M.; Zalkin, H.; Dixon, J. E.: Cloning and characterization of the cDNA encoding human adenylosuccinate synthetase. FEBS Lett. 303:4-10, 1992.
84. Stengel, D.; Parma, J.; Gannage, M.-H.; Roeckel, N.; Mattei, M.-G.; Barouki, R.; Hanoune, J.: Different chromosomal localization of two adenylyl cyclase genes expressed in human brain. Hum. Genet. 90:126-130, 1992.
85. Edelhoff, S.; Villacres, E. C.; Storm, D. R.; Disteche, C. M.: Mapping of adenylyl cyclase genes type I, II, III, IV, V, and VI in mouse. Mammalian Genome 6: 111-113, 1995.
86. Gaudin, C.; Homcy, C. J.; Ishikawa, Y.: Mammalian adenylyl cyclase family members are randomly located on different chromosomes. Hum. Genet. 94: 527-529, 1994.
87. Wong, S. T.; Trinh, K.; Hacker, B.; Chan, G. C. K.; Lowe, G.; Gaggar, A.; Xia, Z.; Gold, G. H.; Storm, D. R.: Disruption of the type IIIadenylyl cyclase gene leads to peripheral and behavioral anosmia intransgenic mice. Neuron 27: 487-497, 2000.
88. El Nemer, W.; Rahuel, C.; Colin, Y.; Gane, P.; Cartron, J. P.; Le Van Kim, C.: Organization of the human LU gene and molecular basis of the Lu(a)/Lu(b) blood group polymorphism. Blood 89: 4608-4616, 1997.
89. Frandson, S.; Atkins, C. J.; Moulds, M.; Poole, J.; Crawford, M. N.; Tippett, P.: Anti-Au(b): the antithetical antibody to anti-Au(a). Vox Sang. 56: 54-56, 1989.
90. Lewis, M.; Kaita, H.; Chown, B.; Giblett, E. R.; Anderson, J.; Cote, G. B.: The Lutheran and Secretor loci: genetic linkage analysis. Am. J. Hum. Genet. 29: 101-106, 1977.
91. Lewis, M.; Kaita, H.; Coghlan, G.; Philipps, S.; Belcher, E.; McAlpine, P. J.; Coopland, G. R.; Woods, R. A.: The chromosome 19 linkage group LDLR, C3, LW, APOC2, LU, SE in man. Ann. Hum. Genet. 52: 137-144, 1988.
92. Lewis, M.; Kaita, H.; Giblett, E. R.; Anderson, J. E.: Lods for Lu: Se and other loci. Cytogenet. Cell Genet. 22: 627-628, 1978.
93. Mohr, J.: Search for linkage between Lutheran blood group and other hereditary characters. Acta Path. Microbiol. Scand. 28: 207-210, 1951.
94. Parsons, S. F.; Lee, G.; Spring, F. A.; Willig, T.-N.; Peters, L. L.; Gimm, J. A.; Tanner, M. J. A.; Mohandas, N.; Anstee, D. J.; Chasis, J. A.: Lutheran blood group glycoprotein and its newly characterized mouse homologue specifically bind alpha-5 chain-containing human laminin with high affinity. Blood 97: 312-320, 2001.

95. Parsons, S. F.; Mallinson, G.; Daniels, G. L.; Green, C. A.; Smythe, J. S.; Anstee, D. J.: Use of domain-deletion mutants to locate Lutheran blood group antigens to each of the five immunoglobulin superfamily domains of the Lutheran glycoprotein: elucidation of the molecular basis of the Lu(a)/Lu(b) and the Au(a)/Au(b) polymorphisms. Blood 89:4219-4225, 1997.

96. Parsons, S. F.; Mallinson, G.; Holmes, C. H.; Houlihan, J. M.; Simpson, K. L.; Mawby, W. J.; Spurr, N. K.; Warne, D.; Barclay, A. N.; Anstee, D. J.: The Lutheran blood group glycoprotein, another member of the immunoglobulin superfamily, is widely expressed in human tissues and is developmentally regulated in human liver. Proc. Nat. Acad. Sci. 92: 5496-5500, 1995.

97. Rahuel, C.; Le Van Kim, C.; Mattei, M. G.; Cartron, J. P.; Colin, Y.: A unique gene encodes splice forms of the B-cell adhesion molecule cell surface glycoprotein of epithelial cancer and of the Lutheran blood group glycoprotein. Blood 88: 1865-1872, 1996.

98. Salmon, C.; Salmon, D.; Liberge, G.; Andre, R.; Tippett, P.; Sanger, R.: Un nouvel antigene de groupe sanguin erythrocytaire present chez80% des sujets de race blanche. Nouv. Rev. Franc. Hemat. 1: 649-661, 1961.

99. Zelinski, T.; Kaita, H.; Johnson, K.; Moulds, M.: Genetic evidence that the gene controlling Au(b) is located on chromosome 19. Vox Sang. 58: 126-128, 1990.

100. Evans, R. M.: The steroid and thyroid hormone receptor superfamily. Science 240:889-895, 1988.

101. Bader, B. L.; Rayburn, H.; Crowley, D.; Hynes, R. O.: Extensive vasculogenesis, angiogenesis, and organogenesis precede lethality in mice lacking all alpha-V integrins. Cell 95: 507-519, 1998.

102. Fernandez-Ruiz, E.; de Villena, F. P.-M.; Rodriguez de Cordoba, S.; Sanchez-Madrid, F.: Regional localization of the human vitronectin receptor alpha-subunit gene (VNRA) to chromosome 2q31-q32. Cytogenet. Cell Genet. 62: 26-28, 1993.

103. Sims, M. A.; Field, S. D.; Barnes, M. R.; Shaikh, N.; Ellington, K.; Murphy, K. E.; Spurr, N.; Campbell, D. A.: Cloning and characterisation of ITGAV, the genomic sequence for human cell adhesion protein (vitronectin) receptor alpha subunit, CD51. Cytogenet. Cell Genet. 89: 268-271, 2000.

104. Suzuki, S.; Argraves, W. S.; Pytela, R.; Arai, H.; Krusius, T.; Pierschbacher, M. D.; Ruoslahti, E.: cDNA and amino acid sequences of the cell adhesion protein receptor recognizing vitronectin reveal a transmembrane domain and homologies with other adhesion protein receptors. Proc. Nat. Acad. Sci. 83: 8614-8618, 1986.

105. Hromas, R.; Collins, S. J.; Hickstein, D.; Raskind, W.; Deaven, L. L.; O'Hara, P.; Hagen, F. S.; Kaushansky, K.: A retinoic acid-responsive human zinc finger gene, MZF-1, preferentially expressed in myeloid cells. J. Biol. Chem. 266: 14183-14187, 1991.

106. Morris, J. F.; Rauscher, F. J., III; Davis, B.; Klemsz, M.; Xu, D.; Tenen, D.; Hromas, R.: The myeloid zinc finger gene, MZF-1, regulates the CD34 promoter in vitro. Blood 86: 3640-3647, 1995.

107. Tommerup, N.; Aagaard, L.; Lund, C. L.; Boel, E.; Baxendale, S.; Bates, G. P.; Lehrach, H.; Vissing, H.: A zinc-finger gene ZNF141 mapping at 4p16.3/D4S90 is a candidate gene for the Wolf-Hirschhorn (4p-) syndrome. Hum. Molec. Genet. 2: 1571-1575, 1993.

108. de Silva, H. V.; Harmony, J. A. K.; Stuart, W. D.; Gil, C. M.; Robbins, J.: Apolipoprotein J: structure and tissue distribution. Biochemistry 29:5380-5389, 1990.

109. de Silva, H. V.; Stuart, W. D.; Park, Y. B.; Mao, S. J. T.; Gil, C. M.; Wetterau, J. R.; Busch, S. J.; Harmony, J. A. K.: Purification and characterization of apolipoprotein J. J. Biol. Chem. 265: 14292-14297, 1990.

110. Dietzsch, E.; Murphy, B. F.; Kirszbaum, L.; Walker, I. D.; Garson, O. M.: Regional localization of the gene for clusterin (SP-40,40; gene symbol CLI) to human chromosome 8p12-p21. Cytogenet. Cell Genet. 61:178-179, 1992.

111. Dragunow, M.; Preston, K.; Dodd, J.; Young, D.; Lawlor, P.; Christie, D.: Clusterin accumulates in dying neurons following status epilepticus. Molec. Brain Res. 32: 279-290, 1995.

112. Duguid, J. R.; Bohmont, C. W.; Liu, N.; Tourtellotte, W. W.: Changes in brain gene expression shared by scrapie and Alzheimer disease. Proc. Nat. Acad. Sci. 86: 7260-7264, 1989.

113. Fink, T. M.; Zimmer, M.; Tschopp, J.; Etienne, J.; Jenne, D. E.; Lichter, P.: Human clusterin (CLI) maps to 8p21 in proximity to the lipoprotein lipase (LPL) gene. Genomics 16: 526-528, 1993.

114. Han, B. H.; DeMattos, R. B.; Dugan, L. L.; Kim-Han, J. S.; Brendza, R. P.; Fryer, J. D.; Kierson, M.; Cirrito, J.; Quick, K.; Harmony, J. A. K.; Aronow, B. J.; Holtzman, D. M.: Clusterin contributes tocaspase-3-independent brain injury following neonatal hypoxia-ischemia. Nature Med. 7: 338-343, 2001.

115. Jenne, D. E.; Tschopp, J.: Clusterin: the intriguing guises of a widely expressed glycoprotein. Trends Biochem. Sci. 17: 154-159, 1992.

116. Kamboh, M. I.; Harmony, J. A. K.; Sepehrnia, B.; Nwankwo, M.; Ferrell, R. E.: Genetic studies of human apolipoproteins. XX. Genetic polymorphism of apolipoprotein J and its impact on quantitative lipid traits in normolipidemic subjects. Am. J. Hum. Genet. 49: 1167-1173, 1991.

117. Kirszbaum, L.; Sharpe, J. A.; Murphy, B.; d'Apice, A. J. F.; Classon, B.; Hudson, P.; Walker, I. D.: Molecular cloning and characterization of the novel, human complement-associated protein, SP-40,40: a link between the complement and reproductive systems. EMBO J. 8: 711-718, 1989.

118. Murphy, B. F.; Kirszbaum, L.; Walker, I. D.; d'Apice, A. J. F.: SP-40,40, a newly identified normal human serum protein found in the SC5b-9 complex of complement and in the immune deposits in glomerulonephritis. J. Clin. Invest. 81: 1858-1864, 1988.

119. O'Bryan, M. K.; Baker, H. W. G.; Saunders, J. R.; Kirszbaum, L.; Walker, I. D.; Hudson, P.; Liu, D. Y.; Glew, M. D.; d'Apice, A. J. F.; Murphy, B. F.: Human seminal clusterin (SP-40,40): isolation and characterization. J. Clin. Invest. 85: 1477-1486, 1990.

120. Purrello, M.; Bettuzzi, S.; Di Pietro, C.; Mirabile, E.; Di Blasi, M.; Rimini, R.; Grzeschik, K.-H.; Ingletti, C.; Corti, A.; Sichel, G.: The gene for SP-40,40, human homolog of rat sulfated glycoprotein 2, rat clusterin, and rat testosterone-repressed prostate message 2, maps to chromosome 8. Genomics 10: 151-156, 1991.

121. Slawin, K.; Sawczuk, I. S.; Olsson, C. A.; Buttyan, R.: Chromosomal assignment of the human homologue encoding SGP-2. Biochem. Biophys. Res. Commun. 172: 160-164, 1990.

122. Gemmill, R. M.; Bemis, L. T.; Lee, J. P.; Sozen, M. A.; Baron, A.; Zeng, C.; Erickson, P. F.; Hooper, J. E.; Drabkin, H. A.: The TRC8 hereditary kidney cancer gene suppresses growth and functions with VHL in a common pathway. Oncogene 21: 3507-3516, 2002.
123. Ju, Y.-T.; Chang, A. C. Y.; She, B.-R.; Tsaur, M.-L.; Hwang, H.-M.; Chao, C. C.-K.; Cohen, S. N.; Lin-Chao, S.: Gas7: a gene expressed preferentially in growth-arrested fibroblasts and terminally differentiated Purkinje neurons affects neurite formation. Proc. Nat. Acad. Sci. 95:11423-11428, 1998.
124. Kurtz, A.; Zimmer, A.: Interspecies fluorescence in situ hybridization further defines synteny homology between mouse chromosome 11 and human chromosome 17. Mammalian Genome 6: 379-380, 1995.
125. Megonigal, M. D.; Cheung, N.-K. V.; Rappaport, E. F.; Nowell, P. C.; Wilson, R. B.; Jones, D. H.; Addya, K.; Leonard, D. G. B.; Kushner, B. H.; Williams, T. M.; Lange, B. J.; Felix, C. A.: Detection of leukemia-associated MLL-GAS7 translocation early during chemotherapy with DNA topoisomerase II inhibitors. Proc. Nat. Acad. Sci. 97:2814-2819, 2000.
126. Chrast, R.; Scott, H. S.; Chen, H.; Kudoh, J.; Rossier, C.; Minoshima, S.; Wang, Y.; Shimizu, N.; Antonarakis, S. E.: Cloning of two human homologs of the *Drosophila* single-minded gene SIM1 on chromosome 6q and SIM2 on 21q within the Down syndrome chromosomal region. Genome Res. 7: 615-624, 1997.
127. Holder, J. L., Jr.; Butte, N. F.; Zinn, A. R.: Profound obesity associated with a balanced translocation that disrupts the SIM1 gene. Hum. Molec. Genet. 9: 101-108, 2000.
128. Michaud, J. L.; Boucher, F.; Melnyk, A.; Gauthier, F.; Goshu, E.; Levy, E.; Mitchell, G. A.; Himms-Hagen, J.; Fan, C.-M.: Sim1 haploinsufficiency causes hyperphagia, obesity and reduction of the paraventricular nucleus of the hypothalamus. Hum. Molec. Genet. 10: 1465-1473, 2001.
129. Fan, C. M.; Kuwana, E.; Bulfone, A.; Fletcher, C. F.; Copeland, N. G.; Jenkins, N. A.; Crews, S.; Martinez, S.; Puelles, L.; Rubenstein, J. L.; Tessier-Lavigne, M.: Expression patterns of two murine homologs of *Drosophila* single-minded suggest possible roles in embryonic patterning and in the pathogenesis of Down syndrome. Molec. Cell. Neurosci. 7:1-16, 1996.
130. Duke-Cohan, J. S.; Gu, J.; McLaughlin, D. F.; Xu, Y.; Freeman, G. J.; Schlossman, S. F.: Attractin (DPPT-L), a member of the CUB family of cell adhesion and guidance proteins, is secreted by activated human T lymphocytes and modulates immune cell interactions. Proc. Nat. Acad. Sci. 95: 11336-11341, 1998.
131. Gunn, T. M.; Miller, K. A.; He, L.; Hyman, R. W.; Davis, R. W.; Azarani, A.; Schlessman, S. F.; Duke-Cohan, J. S.; Barsh, G. S.: The mouse mahogany locus encodes a transmembrane form of human attractin. Nature 398:152-156, 1999.
132. He, L.; Gunn, T. M.; Bouley, D. M.; Lu, X.-Y.; Watson, S. J.; Schlossman, S. F.; Duke-Cohan, J. S.; Barsh, G. S.: A biochemical function for attractin in agouti-induced pigmentation and obesity. Nature Genet. 27:40-47, 2001.
133. Tang, W.; Gunn, T. M.; McLaughlin, D. F.; Barsh, G. S.; Schlossman, S. F.; Duke-Cohan, J. S.: Secreted and membrane attractin result from alternative splicing of the human ATRN gene. Proc. Nat. Acad. Sci. 97: 6025-6030, 2000.
134. Xiao, H.; Neuveut, C.; Tiffany, H. L.; Benkirane, M.; Rich, E. A.; Murphy, P. M.; Jeang, K.-T.: Selective CXCR4 antagonism by Tat: implications for in vivo expansion of coreceptor use by HIV-1. Proc. Nat. Acad. Sci. 97: 11466-11471, 2000.
135. Lin, C.-S.; Aebersold, R. H.; Kent, S. B.; Varma, M.; Leavitt, J.: Molecular cloning and characterization of plastin, a human leukocyte protein expressed in transformed human fibroblasts. Molec. Cell. Biol. 8: 4659-4668, 1988.
136. Lin, C.-S.; Park, T.; Chen, Z. P.; Leavitt, J.: Human plastingenes: comparative gene structure, chromosome location, and differential expression in normal and neoplastic cells. J. Biol. Chem. 268: 2781-2792, 1993.
137. Aggarwal, B. B.; Eessalu, T. E.; Hass, P. E.: Characterization of receptors for human tumour necrosis factor and their regulation by gamma-interferon. Nature 318: 665-667, 1985.
138. Evans, A. M.; Petersen, J. W.; Sekhon, G. S.; DeMars, R.: Mapping of prolactin and tumor necrosis factor-beta genes on human chromosome 6p using lymphoblastoid cell deletion mutants. Somat. Cell Molec. Genet. 15: 203-213, 1989.
139. Gray, P. W.; Aggarwal, B. B.; Benton, C. V.; Bringman, T. S.; Henzel, W. J.; Jarrett, J. A.; Leung, D. W.; Moffat, B.; Ng, P.; Svedersky, L. P.; Palladino, M. A.; Nedwin, G. E.: Cloning and expression of cDNA for human lymphotoxin, a lymphokine with tumour necrosis activity. Nature 312: 721-724, 1984.
140. Jongeneel, C. V.; Briant, L.; Udalova, I. A.; Sevin, A.; Nedospasov, S. A.; Cambon-Thomsen, A.: Extensive genetic polymorphism in the human tumor necrosis factor region and relation to extended HLA haplotypes. Proc. Nat. Acad. Sci. 88: 9717-9721, 1991.
141. Koss, K.; Satsangi, J.; Fanning, G. C.; Welsh, K. I.; Jewell, D. P.: Cytokine (TNF-alpha, LT-alpha, and IL-10) polymorphisms in inflammatory bowel diseases and normal controls: differential effects on production and allele frequencies. Genes Immun. 1: 185-190, 2000.
142. Leonard, W. J.; Donlon, T. A.; Lebo, R. V.; Greene, W. C.: Localization of the gene encoding the human interleukin-2 receptor on chromosome 10. Science 228: 1547-1549, 1985.
143. Webb, G. C.; Campbell, H. D.; Lee, J. S.; Young, I. G.: Mapping the gene for murine T-cell growth factor, Il-2, to bands B-C on chromosome 3 and for the alpha chain of the IL2-receptor, Il-2ra, to bands A2-A3 on chromosome 2. Cytogenet. Cell Genet. 54: 164-168, 1990.
144. Heinzmann, H.; Mao, X.-Q.; Akaiwa, M.; Kreomer, R. T.; Gao, P.-S.; Ohshima, K.; Umeshita, R.; Abe, Y.; Braun, S.; Yamashita, T.; Roberts, M. H.; Sugimoto, R.; and 20 others: Genetic variants of IL-13 signalling and human asthma and atopy. Hum. Molec. Genet. 9: 549-559, 2000.
145. Dean, F. B.; Lian, L.; O'Donnell, M.: cDNA cloning and gene mapping of human homologs for *Schizosaccharomyces pombe* rad17, rad1, and hus1 and cloning of homologs from mouse, *Caenorhabditis elegans*, and *Drosophila melanogaster*. Genomics 54: 424-436, 1998.
146. Dionne, C. A.; Kaplan, R.; Seuanez, H.; O'Brien, S. J.; Jaye, M.: Chromosome assignment by polymerase chain reaction techniques: assignment of the oncogene FGF-5 to human chromosome 4. Biotechniques 8: 190-194, 1990.
147. Hebert, J. M.; Rosenquist, T.; Gotz, J.; Martin, G. R.: FGF5 as a regulator of the hair growth cycle: evidence from targeted and spontaneous mutations. Cell 78: 1017-1025, 1994.
148. Nguyen, C.; Roux, D.; Mattei, M.-G.; de Lapeyriere, O.; Goldfarb, M.; Birnbaum, D.; Jordan, B. R.: The FGF related oncogenes hst and int.2, and the bcl.1 locus are contained within one megabase in bandq13 of chromosome 11, while the fgf.5 oncogene maps to 4q21. Oncogene 3:703-708, 1988.

149. Zhan, X.; Bates, B.; Hu, X.; Goldfarb, M.: The human FGF-5 oncogene encodes a novel protein related to fibroblast growth factors. Molec. Cell. Biol. 8: 3487-3495, 1988.

150. Dryja, T. P.; Rapaport, J.; McGee, T. L.; Nork, T. M.; Schwartz, T. L.: Molecular etiology of low-penetrance retinoblastoma in two pedigrees. Am. J. Hum. Genet. 52: 1122-1128, 1993.

151. Dryja, T. P.; Rapaport, J. M.; Joyce, J. M.; Petersen, R. A.: Molecular detection of deletions involving band q14 of chromosome 13 in retinoblastomas. Proc. Nat. Acad. Sci. 83: 7391-7394, 1986.

152. Dryja, T. P.; Rapaport, J. M.; Weichselbaum, R.; Bruns, G. A. P.: Chromosome 13 restriction fragment length polymorphisms. Hum. Genet. 65: 320-324, 1984.

153. Duane, T. B.: Clinical Ophthalmology. Hagerstown: Harper and Row (pub.) 3: 1980. Pp. 13 only.

154. Duncan, A. M. V.; Morgan, C.; Gallie, B. L.; Phillips, R. A.; Squire, J.: Re-evaluation of the sublocalization of esterase D and its relation to the retinoblastoma locus by in situ hybridization. Cytogenet. Cell Genet. 44: 153-157, 1987.

155. Dunn, J. M.; Phillips, R. A.; Becker, A. J.; Gallie, B. L.: Identification of germline and somatic mutations affecting the retinoblastoma gene. Science 241:1797-1800, 1988.

156. Dunn, J. M.; Phillips, R. A.; Zhu, X.; Becker, A.; Gallie, B. L.: Mutations in the RB1 gene and their effects on transcription. Molec. Cell. Biol. 9: 4596-4604, 1989.

157. Ejima, Y.; Sasaki, M. S.; Kaneko, A.; Tanooka, H.: Types, rates, origin and expressivity of chromosome mutations involving 13q14 in retinoblastoma patients. Hum. Genet. 79: 118-123, 1988.

158. Ejima, Y.; Sasaki, M. S.; Kaneko, A.; Tanooka, H.; Hara, Y.; Hida, T.; Kinoshita, Y.: Possible inactivation of part of chromosome 13 due to 13qXp translocation associated with retinoblastoma. Clin. Genet. 21: 357-361, 1982.

159. Eldridge, R.; O'Meara, K.; Kitchin, D.: Superior intelligence in sighted retinoblastoma patients and their families. J. Med. Genet. 9:331-335, 1972.

160. Falls, H. F.; Neel, J. V.: Genetics of retinoblastoma. Arch. Ophthal. 46: 367-389, 1951.

161. Fitzgerald, P. H.; Stewart, J.; Suckling, R. D.: Retinoblastoma mutation rate in New Zealand and support for the two-hit model. Hum. Genet. 64: 128-130, 1983.

162. Francke, U.: Retinoblastoma and chromosome 13. Cytogenet. Cell Genet. 14: 131-134, 1976.

163. Francois, J.: Retinoblastoma and osteogenic sarcoma. Ophthalmologica 175:185-191, 1977.

164. Francois, J.: Hereditary malignant tumor of the eye. Congenital Anomalies of The Eye. St. Louis: C. V. Mosby Co. (pub.) 1968. Pp. 205-246.

165. Francois, J.; Matton, M. T.; De Bie, S.; Tanaka, Y.; Vandenbulcke, D.: Genesis and genetics of retinoblastoma. Ophthalmologica 170:405-425, 1975.

166. Friend, S. H.; Bernards, R.; Rogelj, S.; Weinberg, R. A.; Rapaport, J. M.; Albert, D. M.; Dryja, T. P.: A human DNA segment with properties of the gene that predisposes to retinoblastoma and osteosarcoma. Nature 323:643-646, 1986.

167. Friend, S. H.; Dryja, T. P.; Weinberg, R. A.: Oncogenes and tumor-suppressing genes. New Eng. J. Med. 318: 618-622, 1988.

168. Friend, S. H.; Horowitz, J. M.; Gerber, M. R.; Wang, X.-F.; Bogenmann, E.; Li, F. P.; Weinberg, R. A.: Deletions of a DNA sequence in retinoblastomas and mesenchymal tumors: organization of the sequence and its encoded-protein. Proc. Nat. Acad. Sci. 84: 9059-9063, 1987. Note: Correction: Proc. Nat. Acad. Sci. 85: 2234 only, 1988.

169. Fukushima, Y.; Kuroki, Y.; Ito, T.; Kondo, I.; Nishigaki, I.: Familial retinoblastoma (mother and son) with 13q14 deletion. Hum. Genet. 77: 104-107, 1987.

170. Fung, Y.-K. T.; Murphree, A. L.; T'Ang, A.; Qian, J.; Hinrichs, S. H.; Benedict, W. F.: Structural evidence for the authenticity of the human retinoblastoma gene. Science 236: 1657-1661, 1987.

171. Gallie, B. L.: Predictive testing for retinoblastoma comes of age. (Editorial) Am. J. Hum. Genet. 61: 279-281, 1997.

172. Gallie, B. L.; Ellsworth, R. M.; Abramson, D. M.; Phillips, R. A.: Retinoma: spontaneous regression of retinoblastoma or benign manifestation of the mutation? Brit. J. Cancer 45: 513-521, 1982.

173. Gallie, B. L.; Phillips, R. A.: Multiple manifestations of theretinoblastoma gene. Birth Defects Orig. Art. Ser. 18(6): 689-701, 1982.

174. Garcia-Cao, M.; Gonzalo, S.; Dean, D.; Blasco, M. A.: A role for the Rb family of proteins in controlling telomere length. Nature Genet. 15 Oct.: 2002. Note: Advance Electronic Publication.

175. Gey, W.: Dq-, multiple Missbildungen und Retinoblastom. Humangenetik 10:362-365, 1970.

176. Niimi, T.; Keck-Waggoner, C. L.; Popescu, N. C.; Zhou, Y.; Levitt, R. C.; Kimura, S.: UGRP1, a uteroglobin/Clara cell secretory protein-related protein, is a novel lung-enriched downstream target gene for the T/EBP/NKX2.1 homeodomain transcription factor. Molec. Endocr. 15: 2021-2036, 2001.

177. Niimi, T.; Munakata, M.; Keck-Waggoner, C. L.; Popescu, N. C.; Levitt, R. C.; Hisada, M.; Kimura, S.: A polymorphism in the human UGRP1 gene promoter that regulates transcription is associated with an increased risk of asthma. Am. J. Hum. Genet. 70: 718-725, 2002.

178. Juwana, J.-P.; Henderikx, P.; Mischo, A.; Wadle, A.; Fadle, N.; Gerlach, K.; Arends, J. W.; Hoogenboom, H.; Pfreundschuh, M.; Renner, C.: EB/RP gene family encodes tubulin binding proteins. Int. J. Cancer 81: 275-284, 1999.

179. Renner, C.; Pfitzenmeier, J.-P.; Gerlach, K.; Held, G.; Ohnesorge, S.; Sahin, U.; Bauer, S.; Pfreundschuh, M.: RP1, a new member of the adenomatous polyposis coli-binding EB1-like gene family, is differently expressed in activated T cells. J. Immun. 159: 1276-1283, 1997.

180. Wadle, A.; Thiel, G.; Mischo, A.; Jung, V.; Pfreundschuh, M.; Renner, C.: Chromosomal localization and promoter analysis of the adenomatous polyposis coli binding protein RP1. Oncogene 20: 5920-5929, 2001.

181. Feng, S.-L. Y.; Guo, Y.; Factor, V. M.; Thorgeirsson, S. S.; Bell, D. W.; Testa, J. R.; Peifley, K. A.; Winkles, J. A.: The Fn14 immediate-early response gene is induced during liver regeneration and highly expressed in both human and murine hepatocellular carcinomas. Am. J. Path. 156: 1253-1261, 2000.

182. Meighan-Mantha, R. L.; Hsu, D. K. W.; Guo, Y.; Brown, S. A. N.; Feng, S.-L. Y.; Peifley, K. A.; Alberts, G. F.; Copeland, N. G.; Gilbert, D. J.; Jenkins, N. A.; Richards, C. M.; Winkles, J. A.: The mitogen-inducible Fn14 gene encodes a type I transmembrane protein that modulates fibroblast adhesion and migration. J. Biol. Chem. 274: 33166-33176, 1999.

183. Eder, P. S.; Kekuda, R.; Stolc, V.; Altman, S.: Characterization of two scleroderma autoimmune antigens that copurify with human ribonuclease P. Proc. Nat. Acad. Sci. 94: 1101-1106, 1997.

184. Bertrand, P.; Poirier, J.; Oda, T.; Finch, C. E.; Pasinetti, G. M.: Association of apolipoprotein E genotype with brain levels of apolipoprotein E and apolipoprotein J (clusterin) in Alzheimer disease. Molec. Brain Res. 33: 174-178, 1995.
185. Birkenmeier, E. H.; Letts, V. A.; Frankel, W. N.; Magenheimer, B. S.; Calvet, J. P.: Sulfated glycoprotein-2 (Sgp-2) maps to mouse chromosome 14. Mammalian Genome 4: 131-132, 1993.
186. Danik, M.; Chabot, J.-G.; Hassan-Gonzalez, D.; Suh, M.; Quirion, R.: Localization of sulfated glycoprotein-2/clusterin mRNA in the rat brain by in situ hybridization. J. Comp. Neurol. 334: 209-227, 1993.
187. Wu, L.; Timmers, C.; Maiti, B.; Saavedra, H. I.; Sang, L.; Chong, G. T.; Nuckolls, F.; Giangrande, P.; Wright, F. A.; Field, S. J.; Greenberg, M. E.; Orkin, S.; Nevins, J. R.; Robinson, M. L.; Leone, G.: The E2F1-3 transcription factors are essential for cellular proliferation. Nature 414: 457-462, 2001.
188. Bruns, G. A. P.; Regina, V. M.: Adenylate kinase-2, a mitochondrial enzyme. Biochem. Genet. 15: 477-486, 1977.
189. Carritt, B.; King, J.; Welch, H. M.: Gene order and localization of enzyme loci on the short arm of chromosome 1. Ann. Hum. Genet. 46:329-335, 1982.
190. Goss, S. J.; Harris, H.: Gene transfer by means of cell fusion. II. The mapping of 8 loci on human chromosome 1 by statistical analysis of gene assortment in somatic cell hybrids. J. Cell Sci. 25: 39-57, 1977.
191. Van Cong, N.; Billardon, C.; Rebourcet, R.; Kaouel, C. L.-B.; Picard, J. Y.; Weil, D.; Frezal, J.: The existence of a second adenylate kinase locus linked to PGM-1 and peptidase-C. Ann. Genet. 15: 213-218, 1972.
192. Pilz, A.; Woodward, K.; Povey, S.; Abbott, C.: Comparative mapping of 50 human chromosome 9 loci in the laboratory mouse. Genomics 25:139-149, 1995.
193. Azem, A.; Kessel, M.; Goloubinoff, P.: Characterization of a functional GroEL-14(GroES-7)-2 chaperonin hetero-oligomer. Science 265: 653-656, 1994.
194. Cheng, M. Y.; Hartl, F.-U.; Martin, J.; Pollock, R. A.; Kalousek, F.; Neupert, W.; Hallberg, E. M.; Hallberg, R. L.; Horwich, A. L.: Mitochondrial heat-shock protein hsp60 is essential for assembly of proteins imported into yeast mitochondria. Nature 337: 620-625, 1989.
195. Ellis, R. J.: The molecular chaperone concept. Semin. Cell Biol. 1:1-9, 1990.
196. Fontaine, B.; Davoine, C.-S.; Durr, A.; Paternotte, C.; Feki, I.; Weissenbach, J.; Hazan, J.; Brice, A.: A new locus for autosomal dominant pure spastic paraplegia, on chromosome 2q24-q34. Am. J. Hum. Genet. 66: 702-707, 2000.
197. Rothman, J. E.: Polypeptide chain binding proteins: catalysts of protein folding and related processes in cells. Cell 59: 591-601, 1989.
198. Saibil, H.; Dong, Z.; Wood, S.; auf der Mauer, A.: Binding of chaperonins. Nature 353: 25-26, 1991.
199. Schmidt, M.; Rutkat, K.; Rachel, R.; Pfeifer, G.; Jaenicke, R.; Viitanen, P.; Lorimer, G.; Buchner, J.: Symmetric complexes of GroE chaperonins as part of the functional cycle. Science 265: 656-659, 1994.
200. Venner, T. J.; Singh, B.; Gupta, R. S.: Nucleotide sequences and novel structural features of human and Chinese hamster hsp60 (chaperonin) gene families. DNA Cell Biol. 9: 545-552, 1990.
201. Jones, M. E. E.; Thorburn, A. W.; Britt, K. L.; Hewitt, K. N.; Wreford, N. G.; Proietto, J.; Oz, O. K.; Leury, B. J.; Robertson, K. M.; Yao, S.; Simpson, E. R.: Aromatase-deficient (ArKO) mice have a phenotype of increased adiposity. Proc. Nat. Acad. Sci. 97: 12735-12740, 2000.
202. Weiher, H.; Noda, T.; Gray, D. A.; Sharpe, A. H.; Jaenisch, R.: Transgenic mouse model of kidney disease: insertional inactivation of ubiquitously expressed gene leads to nephrotic syndrome. Cell 62:425-434, 1990.
203. Kawagishi, J.; Kumabe, T.; Yoshimoto, T.; Yamamoto, T.: Structure, organization, and transcription units of the human alpha-platelet-derived growth factor receptor gene, PDGFRA. Genomics 30: 224-232, 1995.
204. Allore, R.; O'Hanlon, D.; Price, R.; Neilson, K.; Willard, H. F.; Cox, D. R.; Marks, A.; Dunn, R. J.: Gene encoding the beta-subunit of S100 protein is on chromosome 21: implications for Down syndrome. Science 239:1311-1313, 1988.
205. Allore, R. J.; Friend, W. C.; O'Hanlon, D.; Neilson, K. M.; Baumal, R.; Dunn, R. J.; Marks, A.: Cloning and expression of the human S100-beta gene. J. Biol. Chem. 265: 15537-15543, 1990.
206. Duncan, A. M. V.; Higgins, J.; Dunn, R. J.; Allore, R.; Marks, A.: Refined sublocalization of the human gene encoding the beta subunit of the S100 protein (S100B) and confirmation of a subtle t(9;21) translocation using in situ hybridization. Cytogenet. Cell Genet. 50: 234-235, 1989.
207. Reeves, R. H.; Yao, J.; Crowley, M. R.; Buck, S.; Zhang, X.; Yarowsky, P.; Gearhart, J. D.; Hilt, D. C.: Astrocytosis and axonal proliferation in the hippocampus of S100b transgenic mice. Proc. Nat. Acad. Sci. 91:5359-5363, 1994.
208. Kurlan, R.; Behr, J.; Medved, L.; Shoulson, I.; Pauls, D.; Kidd, J. R.; Kidd, K. K.: Familial Tourette's syndrome: report of a large pedigree and potential for linkage analysis. Neurology 36: 772-776, 1986.
209. Jarrous, N.; Eder, P. S.; Guerrier-Takada, C.; Hoog, C.; Altman, S.: Autoantigenic properties of some protein subunits of catalytically active complexes of human ribonuclease P. RNA 4: 407-417, 1998.
210. Fujimoto, K.; Shen, M.; Noshiro, M.; Matsubara, K.; Shingu, S.; Honda, K.; Yoshida, E.; Suardita, K.; Matsuda, Y.; Kato, Y.: Molecular cloning and characterization of DEC2, a new member of basic helix-loop-helix proteins. Biochem. Biophys. Res. Commun. 280: 164-171, 2001.
211. Garriga-Canut, M.; Roopra, A.; Buckley, N. J.: The basic helix-loop-helix protein, SHARP-1, represses transcription by a histone deacetylase-dependent and histone deacetylase-independent mechanism. J. Biol. Chem. 276: 14821-14828, 2001.
212. Gu, H.; Saito, K.; Klaman, L. D.; Shen, J.; Fleming, T.; Wang, Y.-P.; Pratt, J. C.; Lin, G.; Lim, B.; Kinet, J.-P.; Neel, B. G.: Essential role for Gab2 in the allergic response. Nature 412: 186-190, 2001.
213. Albrecht, U.; Sun, Z. S.; Eichele, G.; Lee, C. C.: A differential response to two putative mammalian circadian regulators, mper1 and mper2, to light. Cell 91: 1055-1064, 1997.
214. Nagase, T.; Ishikawa, K.; Nakajima, D.; Ohira, M.; Seki, N.; Miyajima, N.; Tanaka, A.; Kotani, H.; Nomura, N.; Ohara, O.: Prediction of the coding sequences of unidentified human genes. VII. The complete sequences of 100 new cDNA clones from brain which can code for large proteins in vitro. DNA Res. 4: 141-150, 1997.
215. Prueitt, R. L.; Ross, J. L.; Zinn, A. R.: Physical mapping of nine Xq translocation breakpoints and identification of XPNPEP2 as a premature ovarian failure candidate gene. Cytogenet. Cell Genet. 89:44-50, 2000.
216. Sprinkle, T. J.; Stone, A. A.; Venema, R. C.; Denslow, N. D.; Caldwell, C.; Ryan, J. W.: Assignment of the mem- 216. brane-bound human aminopeptidaseP gene (XPNPEP2) to chromosome Xq25. Genomics 50: 114-116, 1998.
217. Venema, R. C.; Ju, H.; Zou, R.; Venema, V. J.; Ryan, J. W.: Cloning and tissue distribution of human membrane-bound aminopeptidase P. Biochim. Biophys. Acta 1354: 45-48, 1997.
218. Ueki, N.; Oda, T.; Kondo, M.; Yano, K.; Noguchi, T.; Muramatsu, M.: Selection system for genes encoding nuclear-targeted proteins. Nat. Biotech. 16: 1338-1342, 1998.
219. Ueki, N.; Seki, N.; Yano, K.; Masuho, Y.; Saito, T.; Muramatsu, M.: Isolation and characterization of a novel human gene (HFB30) which encodes a protein with a RING finger motif. Biochim. Biophys. Acta 232-236, 1999.
220. Salbaum, J. M.: Genomic structure and chromosomal localization of the mouse gene Punc. Mammalian Genome 10: 107-111, 1999.
221. Yang, W.; Li, C.; Mansour, S. L.: Impaired motor coordination in mice that lack punc. Molec. Cell. Biol. 21: 6031-6043, 2001.
222. Fukuta, M.; Inazawa, J.; Torii, T.; Tsuzuki, K.; Shimada, E.; Habuchi, O.: Molecular cloning and characterization of human keratan sulfate gal-6-sulfotransferase. J. Biol. Chem. 272: 32321-32328, 1997.
223. Iida, A.; Saito, S.; Sekine, A.; Mishima, C.; Kitamura, Y.; Kondo, K.; Harigae, S.; Osawa, S.; Nakamura, Y.: Catalog of 77 single-nucleotidepolymorphisms (SNPs) in the carbohydrate sulfotransferase 1 (CHST1) and carbohydrate sulfotransferase 3 (CHST3) genes. J. Hum. Genet. 47:14-19, 2002.
224. Mazany, K. D.; Peng, T.; Watson, C. E.; Tabas, I.; Williams, K. J.: Human chondroitin 6-sulfotransferase: cloning, gene structure, and chromosomal localization. Biochim. Biophys. Acta 1407: 92-97, 1998.
225. Ayres, J. A.; Shum, L.; Akarsu, A. N.; Dashner, R.; Takahashi, K.; Ikura, T.; Slavkin, H. C.; Nuckolls, G. H.: DACH: genomic characterization, evaluation as a candidate for postaxial polydactyly type A2, and developmental expression pattern of the mouse homologue. Genomics 77: 18-26, 2001.
226. Davis, R. J.; Shen, W.; Sandler, Y. I.; Amoui, M.; Purcell, P.; Maas, R.; Ou, C.-N.; Vogel, H.; Beaudet, A. L.; Mardon, G.: Dachimutant mice bear no gross abnormalities in eye, limb, and brain development and exhibit postnatal lethality. Molec. Cell. Biol. 21: 1484-1490, 2001.
227. Hammond, K. L.; Hanson, I. M.; Brown, A. G.; Lettice, L. A.; Hill, R. E.: Mammalian and *Drosophila dachshund* genes are related to the Ski proto-oncogene and are expressed in eye and limb. Mech. Dev. 74:121-131, 1998.
228. Hammond, K. L.; Lettice, L. A.; Hill, R. E.; Lee, M.; Boyle, S.; Hanson, I. M.: Human (DACH) and mouse (Dach) homologues of *Drosophila dachshund* map to chromosomes 13q22 and 14E3, respectively. Genomics 55:252-253, 1999.
229. Li, X.; Perissi, V.; Liu, F.; Rose, D. W.; Rosenfeld, M. G.: Tissue-specific regulation of retinal and pituitary precursor cell proliferation. Science 297:1180-1183, 2002.
230. Blanco, G.; Irving, N. G.; Brown, S. D. M.; Miller, C. C. J.; McLoughlin, D. M.: Mapping of the human and murine X11-like genes (APBA2 and Apba2), the murine Fe65 gene (Apbb1), and the human Fe65-like gene (APBB2): genes encoding phosphotyrosine-binding domain proteins that interact with the Alzheimer's disease amyloid precursor protein. Mammalian Genome 9: 473-475, 1998.
231. Loh, N. Y.; Ambrose, H. J.; Guay-Woodford, L. M.; DasGupta, S.; Nawrotzki, R. A.; Blake, D. J.; Davies, K. E.: Genomic organization and refined mapping of the mouse beta-dystrobrevin gene. Mammalian Genome 9: 857-862, 1998.
232. Peters, M. F.; O'Brien, K. F.; Sadoulet-Puccio, H. M.; Kunkel, L. M.; Adams, M. E.; Froehner, S. C.: Beta-dystrobrevin, a new member of the dystrophin family: identification, cloning, and protein associations. J. Biol. Chem. 272: 50:-31561-31569, 1997.
233. Cavailles, V.; Dauvois, S.; Horset, L. F.; Lopez, G.; Hoare, S.; Kushner, P. J.; Parker, M. G.: Nuclear factor RIP140 modulates transcriptional activation by the estrogen receptor. EMBO J. 14: 3741-3751, 1995.
234. Katsanis, N.; Ives, J. H.; Groet, J.; Nizetic, D.; Fisher, E. M. C.: Localisation of receptor interacting protein 140 (RIP140) within 100 kb of D21S13 on 21q11, a gene-poor region of the human genome. Hum. Genet. 102: 221-223, 1998.
235. Baxendale, S.; MacDonald, M. E.; Mott, R.; Francis, F.; Lin, C.; Kirby, S. F.; James, M.; Zehetner, G.; Hummerich, H.; Valdes, J.; Collins, F. S.; Deaven, L. J.; Gusella, J. F.; Lehrach, H.; Bates, G. P.: A cosmid contig and high resolution restriction map of the 2 megabase region containing the Huntington's disease gene. Nature Genet. 4: 181-186, 1993.
236. Richelda, R.; Ronchetti, D.; Baldini, L.; Cro, L.; Viggiano, L.; Marzella, R.; Rocchi, M.; Otsuki, T.; Lombardi, L.; Maiolo, A. T.; Neri, A.: A novel chromosomal translocation t(4;14)(p16.3;q32) in multiple myeloma involves the fibroblast growth-factor receptor 3 gene. Blood 90: 4062-4070, 1997.
237. Wright, T. J.; Ricke, D. O.; Denison, K.; Abmayr, S.; Cotter, P. D.; Hirschhorn, K.; Keinanen, M.; McDonald-McGinn, D.; Somer, M.; Spinner, N.; Yang-Feng, T.; Zackai, E.; Altherr, M. R.: A transcript map of the newly defined 165 kb Wolf-Hirschhorn syndrome critical region. Hum. Molec. Genet. 6: 317-324, 1997.
238. Borden, L. A.; Smith, K. E.; Gustafson, E. L.; Branchek, T. A.; Weinshank, R. L.: Cloning and expression of a betaine/GABA transporter from human brain. J. Neurochem. 64: 977-984, 1995.
239. Rasola, A.; Galietta, L. J. V.; Barone, V.; Romeo, G.; Bagnasco, S.: Molecular cloning and functional characterization of a GABA/betaine transporter from human kidney. FEBS Lett. 373: 229-233, 1995.
240. Yamauchi, A.; Uchida, S.; Kwon, H. M.; Preston, A. S.; Robey, R. B.; Garcia-Perez, A.; Burg, M. B.; Handler, J. S.: Cloning of a Na(+) and Cl(-)-dependent betaine transporter that is regulated by hypertonicity. J. Biol. Chem. 267: 649-652, 1992.
241. Eisses, J. F.; Kaplan, J. H.: Molecular characterization of hCTR1, the human copper uptake protein. J. Biol. Chem. 277: 29162-29171, 2002.
242. Klomp, A. E. M.; Tops, B. B. J.; van den Berg, I. E. T.; Berger, R.; Klomp, L. W. J.: Biochemical characterization and subcellular localization of human copper transporter 1 (hCTR1). Biochem. J. 364:497-505, 2002.
243. Kuo, Y.-M.; Zhou, B.; Cosco, D.; Gitschier, J.: The copper transporter CTR1 provides an essential function in mammalian embryonic development. Proc. Nat. Acad. Sci. 98: 6836-6841, 2001.
244. Lee, J.; Pena, M. M. O.; Nose, Y.; Thiele, D. J.: Biochemical characterization of the human copper transporter Ctrl. J. Biol. Chem. 277:4380-4387, 2002.
245. Lee, J.; Prohaska, J. R.; Thiele, D. J.: Essential role for mammalian copper transporter Ctrl in copper homeostasis and embryonic development. Proc. Nat. Acad. Sci. 98: 6842-6847, 2001.

246. Moller, L. B.; Petersen, C.; Lund, C.; Horn, N.: Characterization of the hCTR1 gene: genomic organization, functional expression, and identification of a highly homologous processed gene. Gene 257:13-22, 2000.

247. Zhou, B.; Gitschier, J.: hCTR1: a human gene for copper uptake identified by complementation in yeast. Proc. Nat. Acad. Sci. 94:7481-7486, 1997.

248. Amlal, H.; Burnham, C. E.; Soleimani, M.: Characterization of Na(+)/HCO(3-) cotransporter isoform NBC-3. Am. J. Physiol. 276:F903-F913, 1999.

249. Burnham, C. E.; Wang, Z.; Soleimani, M.: Personal Communication. Cincinnati, Ohio. Jun. 1, 2000.

250. Choi, I.; Aalkjaer, C.; Boulpaep, E. L.; Boron, W. F.: An electroneutral sodium/bicarbonate cotransporter NBCn1 and associated sodium channel. Nature 405:571-575, 2000.

251. Ishibashi, K.; Sasaki, S.; Marumo, F.: Molecular cloning of a new sodium bicarbonate cotransporter cDNA from human retina. Biochem. Biophys. Res. Commun. 246: 535-538, 1998.

252. Pushkin, A.; Abuladze, N.; Lee, I.; Newman, D.; Hwang, J.; Kurtz, I.: Mapping of the human NBC3 (SLC4A7) gene to chromosome 3p22. Genomics 57:321-322, 1999. Note: Correction: Genomics 58: 216 and 321-322, 1999.

253. Pushkin, A.; Abuladze, N.; Lee, I.; Newman, D.; Hwang, J.; Kurtz, I.: Cloning, tissue distribution, genomic organization, and functional characterization of NBC3, a new member of the sodium bicarbonate cotransporter-family. J. Biol. Chem. 274: 16569-16575, 1999.

254. Alimova-Kost, M. V.; Imreh, S.; Buchman, V. L.; Ninkina, N. N.: Assignment of phosphotriesterase-related gene (PTER) to human chromosome band 10p12 by in situ hybridization. Cytogenet. Cell Genet. 83:16-17, 1998.

255. Davies, J. A.; Buchman, V. L.; Krylova, O.; Ninkina, N. N.: Molecular cloning and expression pattern of rpr-1, a resiniferatoxin-binding, phosphotriesterase-related protein, expressed in rat kidney tubules. FEBS Lett. 410: 378-382, 1997.

256. Pillutla, R. C.; Shimamoto, A.; Furuichi, Y.; Shatkin, A. J.: Human mRNA capping enzyme (RNGTT) and cap methyltransferase (RNMT) map to 6q16 and 18p11.22-p11.23, respectively. Genomics 54: 351-353, 1998.

257. Ishikawa, K.; Nagase, T.; Nakajima, D.; Seki, N.; Ohira, M.; Miyajima, N.; Tanaka, A.; Kotani, H.; Nomura, N.; Ohara, O.: Prediction of the coding sequences of unidentified human genes. VIII. 78 new cDNA clones from brain which code for large proteins in vitro. DNA Res. 4:307-313, 1997.

258. Pillutla, R. C.; Yue, Z.; Maldonado, E.; Shatkin, A. J.: Recombinant human mRNA cap methyltransferase binds capping enzyme/RNA polymeraseIIo complexes. J. Biol. Chem. 273: 21443-21446, 1998.

259. Tsukamoto, T.; Shibagaki, Y.; Niikura, Y.; Mizumoto, K.: Cloning and characterization of three human cDNAs encoding mRNA (guanine-7)-methyltransferase, an mRNA cap methylase. Biochem. Biophys. Res. Commun. 251: 27-34, 1998.

260. McLoughlin, D. M.; Miller, C. C. J.: The intracellular cytoplasmic domain of the Alzheimer's disease amyloid precursor protein interacts with phosphotyrosine-binding domain proteins in the yeast two-hybrid system. FEBS Lett. 397: 197-200, 1996.

261. Guenette, S. Y.; Chen, J.; Jondro, P. D.; Tanzi, R. E.: Association of a novel human FE65-like protein with the cytoplasmic domain of the beta-amyloid precursor protein. Proc. Nat. Acad. Sci. 93: 10832-10837, 1996.

262. Howard, L.; Nelson, K. K.; Maciewicz, R. A.; Blobel, C. P.: Interaction of the metalloprotease disintegrins MDC9 and MDC15 with two SH3 domain-containing proteins, endophilin I and SH3PX1. J. Biol. Chem. 274: 31693-31699, 1999.

263. Galliano, M.-F.; Huet, C.; Frygelius, J.; Polgren, A.; Wewer, U. M.; Engvall, E.: Binding of ADAM12, a marker of skeletal muscle regeneration, to the muscle-specific actin-binding protein, alpha-actinin-2, is required for myoblast fusion. J. Biol. Chem. 275: 13933-13939, 2000.

264. Gilpin, B. J.; Loechel, F.; Mattei, M.-G.; Engvall, E.; Albrechtsen, R.; Wewer, U. M.: A novel, secreted form of human ADAM 12 (meltrinalpha) provokes myogenesis in vivo. J. Biol. Chem. 273: 157-166, 1998.

265. Yagami-Hiromasa, T.; Sato, T.; Kurisaki, T.; Kamijo, K.; Nabeshima, Y.; Fujisawa-Sehara, A.: A metalloprotease-disintegrin participating in myoblast fusion. Nature 377: 652-656, 1995.

266. Cheng, G.; Ye, Z.-S.; Baltimore, D.: Binding of Bruton's tyrosine kinase to Fyn, Lyn, or Hck through a Src homology 3 domain-mediated interaction. Proc. Nat. Acad. Sci. 91: 8152-8155, 1994.

267. Gibson, S.; Leung, B.; Squire, J. A.; Hill, M.; Arima, N.; Goss, P.; Hogg, D.; Mills, G. B.: Identification, cloning, and characterization of a novel human T-cell-specific tyrosine kinase located at the hematopoietin complex on chromosome 5q. Blood 82: 1561-1572, 1993.

268. Janis, E. M.; Siliciano, J. D.; Isaac, D. D.; Griffin, C. A.; Hawkins, A. L.; Kozak, C. A.; Desiderio, S.: Mapping of the gene for the tyrosine kinase Itk to a region of conserved synteny between mouse chromosome 11 and human chromosome 5q. Genomics 23: 269-271, 1994.

269. Schaeffer, E. M.; Debnath, J.; Yap, G.; McVicar, D.; Liao, X. C.; Littman, D. R.; Sher, A.; Varmus, H. E.; Lenardo, M. J.; Schwartzberg, P. L.: Requirement for Tec kinases Rlk and Itk in T cell receptor signaling and immunity. Science 284: 638-641, 1999.

270. Woods, M. L.; Kivens, W. J.; Adelsman, M. A.; Qiu, Y.; August, A.; Shimizu, Y.: A novel function for the Tec family tyrosine kinase Itk in activation of beta-1 integrins by the T-cell receptor. EMBO J. 20: 1232-1244, 2001.

271. Bisbal, C.; Martinand, C.; Silhol, M.; Lebleu, B.; Salehzada, T.: Cloning and characterization of a RNase L inhibitor: a new component of the interferon-regulated 2-5A pathway. J. Biol. Chem. 270: 13308-13317, 1995.

272. Tong, Q.; Xing, S.; Jhiang, S. M.: Leucine zipper-mediated dimerization is essential for the PTC1 oncogenic activity. J. Biol. Chem. 272:9043-9047, 1997.

273. Orstavik, S.; Natarajan, V.; Tasken, K.; Jahnsen, T.; Sandberg, M.: Characterization of the human gene encoding the type I-alpha and type I-beta cGMP-dependent protein kinase (PRKG1). Genomics 42:311-318, 1997.

274. Orstavik, S.; Sandberg, M.; Berube, D.; Natarajan, V.; Simard, J.; Walter, U.; Gagne, R.; Hansson, V.; Jahnsen, T.: Localization of the human gene for type I cyclic GMP dependent protein kinase to chromosome 10. Cytogenet. Cell Genet. 59: 270-273, 1992.

275. Osborne, K. A; Robichon, A.; Burgess, E.; Butland, S.; Shaw, R. A.; Coulthard, A.; Pereira, H. S.; Greenspan, R. J.; Sokolowski, M. B.: Natural behavior polymorphism due to a cGMP-dependent protein kinase of *Drosophila*. Science 277: 834-836, 1997.

276. Pfeifer, A.; Klatt, P.; Massberg, S.; Ny, L.; Sausbier, M.; Hirneill, C.; Wang, G.-X.; Korth, M.; Aszodi, A.; Andersson, K.-E.; Krombach, F.; Mayerhofer, A.; Ruth, P.;

Fassler, R.; Hofmann, F.: Defective smooth muscle regulation in cGMP kinase I-deficient mice. EMBO J. 17:3045-3051, 1998.

277. Sandberg, M.; Natarajan, V.; Ronander, I.; Kalderon, D.; Walter, U.; Lohmann, S. M.; Jahnsen, T.: Molecular cloning and predicted full-length amino acid sequence of the type I beta isozyme of cGMP-dependent protein kinase from human placenta: tissue distribution and developmental changes in rat. FEBS Lett. 255: 321-329, 1989.

278. Tamura, N.; Itoh, H.; Ogawa, Y.; Nakagawa, O.; Harada, M.; Chun, T.-H.; Suga, S.; Yoshimasa, T.; Nakao, K.: cDNA cloning and gene expression of human type I-alpha cGMP-dependent protein kinase. Hypertension 27:552-557, 1996.

279. Oyen, O.; Myklebust, F.; Scott, J. D.; Hansson, V.; Jahnsen, T.: Human testis cDNA for the regulatory subunit RII alpha of cAMP-dependent protein kinase encodes an alternate amino-terminal region. FEBS Lett. 246:57-64, 1989.

280. Tasken, K.; Naylor, S. L.; Solberg, R.; Jahnsen, T.: Mapping of the gene encoding the regulatory subunit RII-alpha of cAMP-dependent protein kinase (locus PRKAR2A) to human chromosome region 3p21.3-p21.2. Genomics 50:378-381, 1998.

281. Solberg, R.; Sistonen, P.; Traskelin, A.-L.; Berube, D.; Simard, J.; Krajci, P.; Jahnsen, T.; de la Chapelle, A.: Mapping of the regulatory subunits RI-beta and RII-beta of cAMP-dependent protein kinase genes on human chromosome 7. Genomics 14: 63-69, 1992.

282. Cummings, D. E.; Brandon, E. P.; Planas, J. V.; Motamed, K.; Idzerda, R. L.; McKnight, G. S.: Genetically lean mice result from targeted disruption of the RII-beta subunit of protein kinase A. Nature 382::622-626, 1996.

283. Scambler, P.; Oyen, O.; Wainwright, B.; Farrall, M.; Law, H.-Y.; Estivill, X.; Sandberg, M.; Williamson, R.; Jahnsen, T.: Exclusion of catalytic and regulatory subunits of cAMP-dependent protein kinase as candidate genes for the defect causing cystic fibrosis. Am. J. Hum. Genet. 41: 925-932, 1987.

284. Wainwright, B.; Lench, N.; Davies, K.; Scambler, P.; Kruyer, H.; Williamson, R.; Jahnsen, T.; Farrall, M.: A human regulatory subunit of type II cAMP-dependent protein kinase localized by its linkage relationship to several cloned chromosome 7q markers. Cytogenet. Cell Genet. 45: 237-239, 1987.

285. Akiyama, K.; Yokota, K.; Kagawa, S.; Shimbara, N.; Tamura, T.; Akioka, H.; Nothwang, H. G.; Noda, C.; Tanaka, K.; Ichihara, A.: cDNA cloning and interferon gamma down-regulation of proteasomal subunits X and Y. Science 265: 1231-1234, 1994.

286. Driscoll, J.; Brown, M. G.; Finley, D.; Monaco, J. J.: MHC-linked LMP gene products specifically alter peptidase activities of the proteasome. Nature 365:262-264, 1993.

287. Gaczynska, M.; Rock, K. L.; Goldberg, A. L.: Gamma interferon and expression of MHC genes regulate peptide hydrolysis by proteasomes. Nature 365:264-267, 1993.

288. Glynne, R.; Powis, S. H.; Beck, S.; Kelly, A.; Kerr, L. A.; Trowsdale, J.: A proteasome-related gene between the two ABC transporter loci in the class II region of the human MHC. Nature 353: 357-360, 1991.

289. Lin, K.; Thomas, J. T.; McBride, O. W.; Luyten, F. P.: Assignment of a new TGF-beta superfamily member, human cartilage-derived morphogenetic protein-1, to chromosome 20q11.2. Genomics 34: 150-151, 1996.

290. To be, T.; Minoshima, S.; Yamase, S.; Choi, N.-H.; Tomita, M.; Shimizu, N.: Assignment of a human serum glycoprotein SP-40,40 gene (CLI) to chromosome 8. Cytogenet. Cell Genet. 57: 193-195, 1991.

291. Wong, P.; Pineault, J.; Lakins, J.; Taillefer, D.; Leger, J.; Wang, C.; Tenniswood, M.: Genomic organization and expression of the rat TRPM-2 (clusterin) gene, a gene implicated in apoptosis. J. Biol. Chem. 268: 5021-5031, 1993.

292. Wong, P.; Taillefer, D.; Lakins, J.; Pineault, J.; Chader, G.; Tenniswood, M.: Molecular characterization of human TRPM-2/clusterin, a gene associated with sperm maturation, apoptosis and neurodegeneration. Europ. J. Biochem. 221: 917-925, 1994.

293. Phillips, S. A.; Barr, V. A.; Haft, D. H.; Taylor, S. I.; Haft, C. R.: Identification and characterization of SNX15, a novel sortingnexin involved in protein trafficking. J. Biol. Chem. 276: 5074-5084, 2001.

294. Roberts, W. M.; Look, A. T.; Ruossel, M. F.; Sherr, C. J.: Tandem linkage of human CSF-1 receptor (c-fms) and PDGF receptor genes. Cell 55:655-661, 1988.

295. Smith, E. A.; Seldin, M. F.; Martinez, L.; Watson, M. L.; GhoshChoudhury, G.; Lalley, P. A.; Pierce, J.; Aaronson, S.; Barker, J.; Naylor, S. L.; Sakaguchi, A. Y.: Mouse platelet-derived growth factor receptor alpha gene is deleted in W-19H and patch mutations on chromosomes. Proc. Nat. Acad. Sci. 88: 4811-4815, 1991.

296. Stenman, G.; Eriksson, A.; Claesson-Welsh, L.: Human PDGFA receptor gene maps to the same region on chromosome 4 as the KIT oncogene. Genes Chromosomes Cancer 1: 155-158, 1989.

297. Stephenson, D. A.; Mercola, M.; Anderson, E.; Wang, C.; Stiles, C. D.; Bowen-Pope, D. F.; Chapman, V. M.: Platelet-derived growth factor receptor alpha-subunit gene (Pdgfra) is deleted in the mouse patch (Ph) mutation. Proc. Nat. Acad. Sci. 88: 6-10, 1991.

298. Xie, J.; Aszterbaum, M.; Zhang, X.; Bonifas, J. M.; Zachary, C.; Epstein, E.; McCormick, F.: A role of PDGFR-alpha in basal cell carcinoma proliferation. Proc. Nat. Acad. Sci. 98: 9255-9259, 2001.

299. Moog-Lutz, C.; Bouillet, P.; Regnier, C. H.; Tomasetto, C.; Mattei, M. G.; Chenard, M. P.; Anglard, P.; Rio, M. C.; Basset, P.: Comparative expression of the psoriasin (S100A7) and S100C genes in breast carcinoma and colocalization to human chromosome 1q21-q22. Int. J. Cancer 63:297-303, 1995.

300. Tanaka, M.; Adzuma, K.; Iwami, M.; Yoshimoto, K.; Monden, Y.; Itakura, M.: Human calgizzarin: one colorectal cancer-related gene selected by a large scale random cDNA sequencing and northern blot analysis. Cancer Lett. 89: 195-200, 1995.

301. Todoroki, H.; Kobayashi, R.; Watanabe, M.; Minami, H.; Hidaka, H.: Purification, characterization, and partial sequence analysis of a newly identified EF-hand type 13-kDa Ca(2+)-binding protein from smooth muscle and non-muscle tissues. J. Biol. Chem. 266: 18668-18673, 1991.

302. Watanabe, M.; Ando, Y.; Todoroki, H.; Minami, H.; Hidaka, H.: Molecular cloning and sequencing of a cDNA clone encoding a new calcium binding protein, named calgizzarin, from rabbit lung. Biochem. Biophys. Res. Commun. 181: 644-649, 1991.

303. Sullivan, J. L.; Byron, K. S.; Brewster, F. E.; Baker, S. M.; Ochs, H. D.: X-linked lymphoproliferative syndrome: natural history of the immunodeficiency. J. Clin. Invest. 71: 1765-1778, 1983.

304. Sullivan, J. L.; Byron, K. S.; Brewster, F. E.; Purtilo, D. T.: Deficient natural killer cell activity in X-linked lymphoproliferative syndrome. Science 210: 543-545, 1980.

305. Sumazaki, R.; Kanegane, H.; Osaki, M.; Fukushima, T.; Tsuchida, M.; Matsukura, H.; Shinozaki, K.; Kimura, H.; Matsui, A.; Miyawaki, T.: SH2D1A mutations in Japanese males with severe Epstein-Barr virus-associated illnesses. Blood 98: 1268-1270, 2001.

306. Sumegi, J.; Gross, T. G.; Seemayer, T. A.: The molecular genetics of X-linked lymphoproliferative (Duncan's) disease. Cancer, J. Sci. Am. 5: 57-62, 1999.

307. Sumegi, J.; Huang, D.; Lanyi, A.; Davis, J. D.; Seemayer, T. A.; Maeda, A.; Klein, G.; Seri, M.; Wakiguchi, H.; Purtilo, D. T.; Gross, T. G.: Correlation of mutations of the SH2D1A gene and Epstein-Barr virus infection with clinical phenotype and outcome in X-linked lymphoproliferative disease. Blood 96: 3118-3125, 2000.

308. Xiang, X.; Benson, K. F.; Chada, K.: Mini-mouse: disruption of the pygmy locus in a transgenic insertional mutant. Science 247:967-969, 1990.

309. Scriver, C. R.: Vitamin B6 deficiency and dependency in man. Am. J. Dis. Child. 113: 109-114, 1967.

310. Scriver, C. R.; Hutchison, J. H.: The vitamin B6 deficiency syndrome in human infancy: biochemical and clinical observations. Pediatrics 31:240-250, 1963.

311. Uchida, T.; Fujimori, F.; Tradler, T.; Fischer, G.; Rahfeld, J.-U.: Identification and characterization of a 14 kDa human protein as a novel parvulin-like peptidyl prolyl cis/trans isomerase. FEBS Lett. 446:278-282, 1999.

312. Shearman, L. P.; Sriram, S.; Weaver, D. R.; Maywood, E. S.; Chaves, I.; Zheng, B.; Kume, K.; Lee, C. C.; van der Horst, G. T. J.; Hastings, M. H.; Reppert, S. M.: Interacting molecular loops in the mammalian circadian clock. Science 288: 1013-1019, 2000.

313. Charlier, C.; Coppieters, W.; Farnir, F.; Grobet, L.; Leroy, P. L.; Michaux, C.; Mni, M.; Schwers, A.; Vanmanshoven, P.; Hanset, R.; Georges, M.: The mh gene causing double-muscling in cattle maps to bovine chromosome 2. Mammalian Genome 6: 788-792, 1995.

314. Ferrell, R. E.; Conte, V.; Lawrence, E. C.; Roth, S. M.; Hagberg, J. M.; Hurley, B. F.: Frequent sequence variation in the human myostatin (GDF8) gene as a marker for analysis of muscle-related phenotypes. Genomics 62:203-207, 1999.

315. Gonzalez-Cadavid, N. F.; Taylor, W. E.; Yarasheski, K.; Sinha-Hikim, I.; Ma, K.; Ezzat, S.; Shen, R.; Lalani, R.; Asa, S.; Mamita, M.; Nair, G.; Arver, S.; Bhasin, S.: Organization of the human myostatin gene and expression in healthy men and HIV-infected men with muscle wasting. Proc. Nat. Acad. Sci. 95: 14938-14943, 1998.

316. Grobet, L.; Martin, L. J. R.; Poncelet, D.; Pirottin, D.; Brouwers, B.; Riquet, J.; Schoeberlein, A.; Dunner, S.; Menissier, F.; Massabanda, J.; Fries, R.; Hanset, R.; Georges, M.: A deletion in the bovine myostatin gene causes the double-muscled phenotype in cattle. Nature Genet. 17: 71-74, 1997.

317. Chikuba, K.; Yubisui, T.; Shirabe, K.; Takeshita, M.: Cloning and nucleotide sequence of a cDNA of the human erythrocyte NADPH-flavin reductase. Biochem. Biophys. Res. Commun. 198: 1170-1176, 1994.

318. Saito, F.; Yamaguchi, T.; Komuro, A.; To be, T.; Ikeuchi, T.; Tomita, M.; Nakajima, H.: Mapping of the newly identified biliverdin-IX beta-reductase gene (BLVRB) to human chromosome 19q13.13-q13.2 by fluorescence in situ hybridization. Cytogenet. Cell Genet. 71: 179-181, 1995.

319. Yamaguchi, T.; Komuro, A.; Nakano, Y.; Tomita, M.; Nakajima, H.: Complete amino acid sequence of biliverdin-IX beta reductase from human liver. Biochem. Biophys. Res. Commun. 197: 1518-1523, 1993.

320. Kosaki, K.; Bassi, M. T.; Kosaki, R.; Lewin, M.; Belmont, J.; Schauer, G.; Casey, B.: Characterization and mutation analysis of human LEFTYA and LEFTY B, homologues of murine genes implicated in left-right axis development. Am. J. Hum. Genet. 64: 712-721, 1999.

321. Kothapalli, R.; Buyuksal, I.; Wu, S.-Q.; Chegini, N.; Tabibzadeh, S.: Detection of ebaf, a novel human gene of the transforming growth factor beta superfamily: association of gene expression with endometrial bleeding. J. Clin. Invest. 99: 2342-2350, 1997.

322. Meno, C.; Itoh, Y.; Saijoh, Y.; Matsuda, Y.; Tashiro, K.; Kuhara, S.; Hamada, H.: Two closely-related left-right asymmetrically expressed genes, lefty-1 and lefty-2: their distinct expression domains, chromosomal linkage and direct neuralizing activity in Xenopus embryos. Genes Cells 2: 513-524, 1997.

323. Meno, C.; Saijoh, Y.; Fujii, H.; Ikeda, M.; Yokoyama, T.; Yokoyama, M.; Toyoda, Y.; Hamada, H.: Left-right asymmetric expression of the TGF-beta-family member lefty in mouse embryos. Nature 381: 151-155, 1996.

324. Meno, C.; Shimono, A.; Saijoh, Y.; Yashiro, K.; Mochida, K.; Ohishi, S.; Noji, S.; Kondoh, H.; Hamada, H.: Lefty-1 is required for left-right determination as a regulator of lefty-2 and nodal. Cell 94: 287-297, 1998.

325. Tabibzadeh, S.; Mason, J. M.; Shea, W.; Cai, Y.; Murray, M. J.; Lessey, B.: Dysregulated expression of ebaf, a novel molecular defect in the endometria of patients with infertility. J. Clin. Endocr. Metab. 85: 2526-2536, 2000.

326. Kamitani, T.; Chang, H.-M.; Rollins, C.; Waneck, G. L.; Yeh, E. T. H.: Correction of the class A defect in glycosylphosphatidylinositol anchor biosynthesis in Ltk-cells by human cDNA clone. J. Biol. Chem. 268:20733-20736, 1993.

327. Cirullo, R. E.; Arredondo-Vega, F. X.; Smith, M.; Wasmuth, J. J.: Isolation and characterization of interspecific heat-resistant hybrids between a temperature-sensitive Chinese hamster cell asparaginyl-tRNA synthetase mutant and normal human leukocytes: assignment of human asnS gene to chromosome 18. Somat. Cell Genet. 9: 215-233, 1983.

328. Shows, T. B.: Personal Communication. Buffalo, N.Y. Jan. 11, 1983.

329. Lin, S.-C.; Lin, C. R.; Gukovsky, I.; Lusis, A. J.; Sawchenko, P. E.; Rosenfeld, M. G.: Molecular basis of the little mouse phenotype and implications for cell type-specific growth. Nature 364: 208-213, 1993.

330. Itoh, H.; Tomita, M.; Uchino, H.; Kobayashi, T.; Kataoka, H.; Sekiya, R.; Nawa, Y.: cDNA cloning of rat pS2 peptide and expression of trefoil peptides in acetic acid-induced colitis. Biochem. J. 318: 939-944, 1996.

331. Seib, T.; Blin, N.; Hilgert, K.; Seifert, M.; Theisinger, B.; Engel, M.; Dooley, S.; Zang, K.-D.; Welter, C.: The three human trefoil genes TFF1, TFF2, and TFF3 are located within a region of 55 kb on chromosome 21q22.3. Genomics 40: 200-202, 1997.

332. Hruban, R. H.; Goggins, M.; Parsons, J.; Kern, S. E.: Clin. Cancer Res. 6: 2969-2972, 2000.

333. Hruban, R. H.; van Mansfield, A. D. M.; Offerhaus, G. J. A.; van Weering, D. H. J.; Allison, D. C.; Goodman, S. N., Kensler, T. W.; Bose, K. K.; Cameron, J. L.; Bos, J. L.: Am. J. Path. 143: 545-554, 1993.

334. Hruban, R. H.; Wilentz, R. E.; Kern, S. E.: Am. J. Pathol. 156:1821-1825, 2000.

335. Fazioli, F.; Minichiello, L.; Matoska, V.; Castagnino, P.; Miki, T.; Wong, W. T.; Di Fiore, P. P.: Eps8, a substrate for the epidermal growth factor receptor kinase, enhances EGF-dependent mitogenic signals. EMBO J. 12: 3799-3808, 1993.

336. Kumar, S.; Tomooka, Y.; Noda, M.: Identification of a set of genes with developmentally down-regulated expression in the mouse brain. Biochem. Biophys. Res. Commun. 185: 1155-1161, 1992.

337. Braybrooke, J. P.; Spink, K. G.; Thacker, J.; Hickson, I. D.: The RAD51 family member, RAD51L3, is a DNA-stimulated ATPase that forms a complex with XRCC2. J. Biol. Chem. 275: 29100-29106, 2000.

338. Johnson, R. D.; Liu, N.; Jasin, M.: Mammalian XRCC2 promotes there pair of DNA double-str and breaks by homologous recombination. Nature 401:397-399, 1999.

339. Jones, N. J.; Cox, R.; Thacker, J.: Isolation and cross-sensitivity of x-ray-sensitive mutants of V79-4 hamster cells. Mutat. Res. 183:279-286, 1987.

340. Jones, N. J.; Zhao, Y.; Siciliano, M. J.; Thompson, L. H.: Assignment of the XRCC2 human DNA repair gene to chromosome 7q36 by complementation analysis. Genomics 26: 619-622, 1995.

341. Kurumizaka, H.; Ikawa, S.; Nakada, M.; Enomoto, R.; Kagawa, W.; Kinebuchi, T.; Yamazoe, M.; Yokoyama, S.; Shibata, T.: Homologous pairing and ring and filament structure formation activities of the human Xrcc2-Rad51D complex. J. Biol. Chem. 277: 14315-14320, 2002.

342. Liu, N.; Schild, D.; Thelen, M. P.; Thompson, L. H.: Involvement of Rad51C in two distinct protein complexes of Rad51 paralogs in human cells. Nucleic Acids Res. 30: 1009-1015, 2002.

343. Masson, J.-Y.; Tarsounas, M. C.; Stasiak, A. Z.; Stasiak, A.; Shah, R.; McIlwraith, M. J.; Benson, F. E.; West, S. C.: Identification and purification of two distinct complexes containing the five RAD51 paralogs. Genes Dev. 15: 3296-3307, 2001.

344. Tambini, C. E.; George, A. M.; Rommens, J. M.; Tsui, L.-C.; Scherer, S. W.; Thacker, J.: The XRCC2 DNA repair gene: identification of a positional candidate. Genomics 41: 84-92, 1997.

345. Thacker, J.; Tambini, C. E.; Simpson, P. J.; Tsui, L.-C.; Scherer, S. W.: Localization to chromosome 7q36.1 of the human XRCC2 gene, determining sensitivity to DNA-damaging agents. Hum. Molec. Genet. 4:113-120, 1995.

346. Nakagawara, A.; Liu, X.-G.; Ikegaki, N.; White, P. S.; Yamashiro, D. J.; Nycum, L. M.; Biegel, J. A.; Brodeur, G. M.: Cloning and chromosomal localization of the human TRKB tyrosine kinase receptor gene (NTRK2). Genomics 25:538-546, 1995.

347. Rico, B.; Xu, B.; Reichardt, L. F.: TrkB receptor signaling is required for establishment of GABAergic synapses in the cerebellum. Nature Neurosci. 5: 225-233, 2002.

348. Slaugenhaupt, S. A.; Blumenfeld, A.; Liebert, C. B.; Mull, J.; Lucente, D. E.; Monahan, M.; Breakefield, X. O.; Maayan, C.; Parada, L.; Axelrod, F. B.; Gusella, J. F.: The human gene for neurotrophic tyrosine kinase receptor type 2 (NTRK2) is located on chromosome 9 but is not the familial dysautonomia gene. Genomics 25: 730-732, 1995.

349. Soppet, D.; Escandon, E.; Maragos, J.; Middlemas, D. S.; Reid, S. W.; Blair, J.; Burton, L. E.; Stanton, B. R.; Kaplan, D. R.; Hunter, T.; Nikolics, K.; Parada, L. F.: The neurotrophic factors brain-derived neurotrophic factor and neurotrophin-3 are ligands for the trkB tyrosinekinase receptor. Cell 65: 895-903, 1991.

350. Squinto, S. P.; Stitt, S. N.; Aldrich, T. H.; Davis, S.; Bianco, S. M.; Radziejewski, C.; Glass, D. J.; Masiakowski, P.; Furth, M. E.; Valenzuela, D. M.; DiStefano, P. S.; Yancopoulos, G. D.: trkBencodes a functional receptor for brain-derived neurotrophic factor and neurotrophin-3 but not nerve growth factor. Cell 65: 885-893, 1991.

351. Burks, D. J.; Font de Mora, J.; Schubert, M.; Withers, D. J.; Myers, M. G.; Towery, H. H.; Altamuro, S. L.; Flint, C. L.; White, M. F.: IRS-2 pathways integrate female reproduction and energy homeostasis. Nature 407:377-382, 2000.

352. Fritsche, A.; Madaus, A.; Renn, W.; Tschritter, O.; Teigeler, A.; Weisser, M.; Maerker, E.; Machicao, F.; Haring, H.; Stumvoll, M.: The prevalent Gly1057Asp polymorphism in the insulin receptor substrate-2 gene is not associated with impaired insulin secretion. J. Clin. Endocr. Metab. 86: 4822-4825, 2001.

353. Kubota, N.; To be, K.; Terauchi, Y.; Eto, K.; Yamauchi, T.; Suzuki, R.; Tsubamoto, Y.; Komeda, K.; Nakano, R.; Miki, H.; Satoh, S.; Sekihara, H.; Sciacchitano, S.; Lesniak, M.; Aizawa, S.; Nagai, R.; Kimura, S.; Akanuma, Y.; Taylor, S. I.; Kadowaki, T.: Disruption of insulin receptor substrate 2 causes type 2 diabetes because of liver insulin resistance and lack of compensatory beta-cell hyperplasia. Diabetes 49::-1880-1889, 2000.

354. Sun, X. J.; Wang, L.-M.; Zhang, Y.; Yenush, L.; Myers, M. G., Jr.; Glasheen, E.; Lane, W. S.; Pierce, J. H.; White, M. F.: Role of IRS-2 in insulin and cytokine signalling. Nature 377: 173-177, 1995.

355. Withers, D. J.; Burks, D. J.; Towery, H. H.; Altamuro, S. L.; Flint, C. L.; White, M. F.: Irs-2 coordinates Igf-1 receptor-mediated beta-cell development and peripheral insulin signalling. Nature Genet. 23:32-40, 1999.

356. Withers, D. J.; Gutierrez, J. S.; Towery, H.; Burks, D. J.; Ren, J.-M.; Previs, S.; Zhang, Y.; Bernal, D.; Pons, S.; Shulman, G. I.; Bonner-Weir, S.; White, M. F.: Disruption of IRS-2 causes type 2 diabetes in mice. Nature 391: 900-902, 1998.

357. Wong, W. T.; Carlomagno, F.; Druck, T.; Barletta, C.; Croce, C. M.; Huebner, K.; Kraus, M. H.; Di Fiore, P. P.: Evolutionary conservation of the EPS8 gene and its mapping to human chromosome 12q23-q24. Oncogene 9:3057-3061, 1994.

358. Peters, M. A.; Ostrander, E. A.: Prostate cancer: more than two to tango. Nature Genet. 27: 134-135, 2001.

359. Chen, S. L.; Dowhan, D. H.; Hosking, B. M.; Muscat, G. E. O.: The steroid receptor coactivator, GRIP-1, is necessary for MEF-2C-dependent gene expression and skeletal muscle differentiation. Genes Dev. 14:1209-1228, 2000.

360. Yoshida, M. C.; Sasaki, M.; Mise, K.; Semba, K.; Nishizawa, M.; Yamamoto, T.; Toyoshima, K.: Regional mapping of the human proto-oncogene c-yes-1 to chromosome 18 at band q21.3. Jpn. J. Cancer Res. 76:559-562, 1985.

361. Goossens, M.; Brauner, R.; Czernichow, P.; Duquesnoy, P.; Rappaport, R.: Isolated growth hormone (GH) deficiency type 1A associated with a double deletion in the human GH gene cluster. J. Clin. Endocr. Metab. 62: 712-716, 1986.

362. Cool, D. R.; Normant, E.; Shen, F.; Chen, H.-C.; Pannell, L.; Zhang, Y.; Loh, Y. P.: Carboxypeptidase E is a regulated secretory pathway sorting receptor: genetic obliteration leads to endocrine disorders in Cpe(fat) mice. Cell 88: 73-83, 1997.

363. Nicoloso, M.; Caizergues-Ferrer, M.; Michot, B.; Azum, M.-C.; Bachellerie, J.-P.: U20, a novel small nucleolar RNA, is encoded in an intron of the nucleolin gene in mammals. Molec. Cell. Biol. 14: 5766-5776, 1994.

364. Srivastava, M.; Fleming, P. J.; Pollard, H. B.; Burns, A. L.: Cloning and sequencing of the human nucleolin cDNA. FEBS Lett. 250:99-105, 1989.

365. Srivastava, M.; McBride, O. W.; Fleming, P. J.; Pollard, H. B.; Burns, A. L.: Genomic organization and chromosomal localization of the human nucleolin gene. J. Biol. Chem. 265: 14922-14931, 1990.

366. Campbell, G. R.; Zimmerman, K.; Blank, R. D.; Alt, F. W.; D'Eustachio, P.: Chromosomal location of N-myc and L-myc genes in the mouse. Oncogene Res. 4: 47-54, 1989.

367. Bahou, W. F.; Nierman, W. C.; Durkin, A. S.; Potter, C. L.; Demetrick, D. J.: Chromosomal assignment of the human thrombin receptor gene: localization to region q13 of chromosome 5. Blood 82: 1532-1537, 1993.

368. Coughlin, S. R.; Vu, T.-K. H.; Hung, D. T.; Wheaton, V. I.: Characterization of a functional thrombin receptor: issues and opportunities. J. Clin. Invest. 89: 351-355, 1992.

369. Griffin, C. T.; Srinivasan, Y.; Zheng, Y.-W.; Huang, W.; Coughlin, S. R.: A role for thrombin receptor signaling in endothelial cells during embryonic development. Science 293: 1666-1670, 2001.

370. Poirier, C.; O'Brien, E. P.; Bueno Brunialti, A. L.; Chambard, J.-C.; Swank, R. T.; Guenet, J.-L.: The gene encoding the thrombin receptor (Cf2r) maps to mouse chromosome 13. Mammalian Genome 7:322, 1996.

371. Schmidt, V. A.; Nierman, W. C.; Feldblyum, T. V.; Maglott, D. R.; Bahou, W. F.: The human thrombin receptor and proteinase activated receptor-2 genes are tightly linked on chromosome 5q13. Brit. J. Haemat. 97: 523-529, 1997.

372. Schmidt, V. A.; Vitale, E.; Bahou, W. F.: Genomic cloning and characterization of the human thrombin receptor gene: structural similarity to the proteinase activated receptor-2 gene. J. Biol. Chem. 271:9307-9312, 1996.

373. Vu, T.-K. H.; Hung, D. T.; Wheaton, V. I.; Coughlin, S. R.: Molecular cloning of a functional thrombin receptor reveals a novel proteolytic mechanism of receptor activation. Cell 64: 1057-1068, 1991.

374. Bravo, R.: Synthesis of the nuclear protein cyclin (PCNA) and its relationship with DNA replication. Exp. Cell Res. 163: 287-293, 1986.

375. Hasan, S.; Hassa, P. O.; Imhof, R.; Hottiger, M. O.: Transcription coactivator p300 binds PCNA and may have a role in DNA repair synthesis. Nature 410:387-391, 2001.

376. Hoege, C.; Pfander, B.; Moldovan, G.-L.; Pyrowolakis, G.; Jentsch, S.: RAD6-dependent DNA repair is linked to modification of PCNA by ubiquitin and SUMO. Nature 419: 135-141, 2002.

377. Ku, D.-H.; Travali, S.; Calabretta, B.; Huebner, K.; Baserga, R.: Human gene for proliferating cell nuclear antigen has pseudo genes and localizes to chromosome 20. Somat. Cell Molec. Genet. 15: 297-307, 1989.

378. Mann, M. J.; Gibbons, G. H.; Kernoff, R. S.; Diet, F. P.; Tsao, P. S.; Cooke, J. P.; Kaneda, Y.; Dzau, V. J.: Genetic engineering of vein grafts resistant to atherosclerosis. Proc. Nat. Acad. Sci. 92:4502-4506, 1995.

379. Rao, V. V. N. G.; Schnittger, S.; Hansmann, I.: Chromosomal localization of the human proliferating cell nuclear antigen (PCNA) gene to or close to 20p12 by in situ hybridization. Cytogenet. Cell Genet. 56:169-170, 1991.

380. Suzuka, I.; Daidoji, H.; Matsuoka, M.; Kadowaki, K.; Takasaki, Y.; Nakane, P. K.; Moriuchi, T.: Gene for proliferating-cell nuclear antigen (DNA polymerase delta auxiliary protein) is present in both mammalian and higher plant genomes. Proc. Nat. Acad. Sci. 86: 3189-3193, 1989.

381. Taniguchi, Y.; Katsumata, Y.; Koido, S.; Suemizu, H.; Yoshimura, S.; Moriuchi, T.; Okumura, K.; Kagotani, K.; Taguchi, H.; Imanishi, T.; Gojobori, T.; Inoko, H.: Cloning, sequencing, and chromosomal localization of two tandemly arranged human pseudo genes for the proliferating cell nuclear antigen (PCNA). Mammalian Genome 7: 906-908, 1996.

382. Travali, S.; Ku, D.-H.; Rizzo, M. G.; Ottavio, L.; Baserga, R.; Calabretta, B.: Structure of the human gene for the proliferating cell nuclear antigen. J. Biol. Chem. 264: 7466-7472, 1989.

383. Webb, G.; Parsons, P.; Chenevix-Trench, G.: Localization of the gene for human proliferating nuclear antigen/cyclin by in situ hybridization. Hum. Genet. 86: 84-86, 1990.

384. Fonatsch, C.; Duchrow, M.; Rieder, H.; Schluter, C.; Gerdes, J.: Assignment of the human Ki-67 gene (MKI67) to 10q25-qter. Genomics 11:476-477, 1991.

385. Schluter, C.; Duchrow, M.; Wohlenberg, C.; Becker, M. H. G; Key, G.; Flad, H.-D.; Gerdes, J.: The cell proliferation-associated antigen of antibody Ki-67: a very large, ubiquitous nuclear protein with numerous repeated elements, representing a new kind of cell cycle-maintaining proteins. J. Cell. Biol. 123: 513-522, 1993.

386. Schonk, D. M.; Kuijpers, H. J. H.; van Drunen, E.; van-Dalen, C. H.; Geurts van Kessel, A. H. M.; Verheijen, R.; Ramaekers, F. C. S.: Assignment of the gene(s) involved in the expression of the proliferation-related Ki-67 antigen to human chromosome 10. Hum. Genet. 83: 297-299, 1989.

387. Traut, W.; Scholzen, T.; Winking, H.; Kubbutat, M. H. G.; Gerdes, J.: Assignment of the murine Ki-67 gene (Mki67) to chromosome band 7F3-F5 by in situ hybridization. Cytogenet. Cell Genet. 83: 12-13, 1998.

388. Fukata, M.; Watanabe, T.; Noritake, J.; Nakagawa, M.; Yamaga, M.; Kuroda, S.; Matsuura, Y.; Iwamatsu, A.; Perez, F.; Kaibuchi, K.: Rac1 and Cdc42 capture microtubules through IQGAP1 and CLIP-170. Cell 109:873-885, 2002.

389. Brown, M. A.; Nicolai, H.; Xu, C.-F.; Griffiths, B. L.; Jones, K. A.; Solomon, E.; Hosking, L.; Trowsdale, J.; Black, D. M.; McFarlane, R.: Regulation of BRCA1. (Letter) Nature 372: 733 only, 1994.

390. Brown, M. A.; Xu, C.-F.; Nicolai, H.; Griffiths, B.; Chambers, J. A.; Black, D.; Solomon, E.: The 5-prime end of the BRCA1 gene lies within a duplicated region of human chromosome 17q21. Oncogene 12:2507-2513, 1996.

391. Campbell, I. G.; Nicolai, H. M.; Foulkes, W. D.; Senger, G.; Stamp, G. W.; Allan, G.; Boyer, C.; Jones, K.; Bast, R. C., Jr.; Solomon, E.; Trowsdale, J.; Black, D. M.: A novel gene encoding a B-box protein within the BRCA1 region at 17q21.1. Hum. Molec. Genet. 3: 589-594, 1994.

392. Kawashima, K.; Shikama, H.; Imoto, K.; Izawa, M.; Naruke, T.; Okabayashi, K.; Nishimura, S.: Close correlation between restriction fragment length polymorphism of the L-MYC gene and metastasis of human lung cancer to the lymph nodes and other organs. Proc. Nat. Acad. Sci. 85:2353-2356, 1988.

393. Kaye, F.; Battey, J.; Nau, M.; Brooks, B.; Seifter, E.; De Greve, J.; Birrer, M.; Sausville, E.; Minna, J.: Structure and expression of the human L-myc gene reveal a complex pattern of alternative mRNA processing. Molec. Cell. Biol. 8: 186-195, 1988.

394. McBride, O. W.; Kirsch, I.; Hollis, G.; Nau, M.; Battey, J.; Minna, J.: Human L-myc (MYCL) proto-oncogene is on chromosome 1p32. (Abstract) Cytogenet. Cell Genet. 40: 694 only, 1985.

395. Nau, M. M.; Brooks, B. J.; Battey, J.; Sausville, E.; Gazdar, A. F.; Kirsch, I. R.; McBride, O. W.; Bertness, V.;

Hollis, G. F.; Minna, J. D.: L-myc, a new myc-related gene amplified and expressed in human small cell lung cancer. Nature 318: 69-73, 1985.
396. Rouleau, G. A.; Bazanowski, A.; Gusella, J. F.; Haines, J. L.: A genetic map of chromosome 1: comparison of different data sets and linkage programs. Genomics 7: 313-318, 1990.
397. Speleman, F.; Van Camp, G.; Van Roy, N.: Reassignment of MYCL1 to human chromosome 1p34.3 by fluorescence in situ hybridization. Cytogenet. Cell Genet. 72: 189-190, 1996.
398. Van Roy, N.; Cheng, N. C.; Laureys, G.; Opdenakker, G.; Versteeg, R.; Speleman, F.: Molecular cytogenetic analysis of 1;17 translocations in neuroblastoma. Europ. J. Cancer 31A: 530-535, 1995.
399. Akiyama, T.; Sudo, C.; Ogawara, H.; Toyoshima, K.; Yamamoto, T.: The product of the human c-erbB-2 gene: a 185-kilodalton glycoprotein with tyrosine kinase activity. Science 232: 1644-1646, 1986.
400. Ameyaw, M.-M.; Tayeb, M.; Thornton, N.; Folayan, G.; Tariq, M.; Mobarek, A.; Evans, D. A. P.; Ofori-Adjei, D.; McLeod, H. L.: Ethnic variation in the HER-2 codon 655 genetic polymorphism previously associated with breast cancer. J. Hum. Genet. 47: 172-175, 2002.
401. Chen, S.-H.; Anderson, J. E.; Giblett, E. R.: Human red cell 2,3-diphosphoglyceratemutase and monophosphoglycerate mutase: genetic evidence for two separate loci. Am. J. Hum. Genet. 29: 405-407, 1977.
402. Pol, S.; Bousquet-Lemercier, B.; Pave-Preux, M.; Pawlak, A.; Nalpas, B.; Berthelot, P.; Hanoune, J.; Barouki, R.: Nucleotide sequence and tissue distribution of the human mitochondrial aspartate aminotransferase mRNA. Biochem. Biophys. Res. Commun. 157: 1309-1315, 1988.
403. Becker, D. M.; Fikes, J. D.; Guarente, L.: A cDNA encoding a human CCAAT-binding protein cloned by functional complementation in yeast. Proc. Nat. Acad. Sci. 88: 1968-1972, 1991.
404. Parmentier, M.; Passage, E.; Vassart, G.; Mattei, M.-G.: The human calbindin D28k (CALB1) and calretinin (CALB2) genes are located at 8q21.3-q22.1 and 16q22-q23, respectively, suggesting a common duplication with the carbonic anhydrase isozyme loci. Cytogenet. Cell Genet. 57:41-43, 1991.
405. Parmentier, M.; Szpirer, J.; Levan, G.; Vassart, G.: The human genes for calbindin 27 and 29 kDa proteins are located on chromosomes 8 and 16, respectively. Cytogenet. Cell Genet. 52: 85-87, 1989.
406. Schiffmann, S. N.; Cheron, G.; Lohof, A.; d'Alcantara, P.; Meyer, M.; Parmentier, M.; Schurmans, S.: Impaired motor coordination and Purkinje cell excitability in mice lacking calretinin. Proc. Nat. Acad. Sci. 96: 5257-5262, 1999.
407. Bibel, M.; Barde, Y.-A.: Neurotrophins: key regulators of cell fate and cell shape in the vertebrate nervous system. Genes Dev. 14:2919-2937, 2000.
408. Bothwell, M.: p75(NTR): a receptor after all. Science 272: 506-507, 1996.
409. Carter, B. D.; Lewin, G. R.: Neurotrophins live or let die: does p75(NTR) decide? Neuron 18: 187-190, 1997.
410. Jackson, R. S.; Creemers, J. W. M.; Ohagi, S.; Raffin-Sanson, M.-L.; Sanders, L.; Montague, C. T.; Hutton, J. C.; O'Rahilly, S.: Obesity and impaired prohormone processing associated with mutations in the human prohormone convertase 1 gene. Nature Genet. 16: 303-306, 1997.
411. Naggert, J. K.; Fricker, L. D.; Varlamov, O.; Nishina, P. M.; Rouille, Y.; Steiner, D. F.; Carroll, R. J.; Paigen, B. J.; Leiter, E. H.: Hyperproinsulinaemia in obese fat/fat mice associated with a carboxypeptidase E mutation which reduces enzyme activity. Nature Genet. 10: 135-142, 1995.
412. O'Rahilly, S.; Gray, H.; Humphreys, P. J.; Krook, A.; Polonsky, K. S.; White, A.; Gibson, S.; Taylor, K.; Carr, C.: Brief report: impaired processing of prohormones associated with abnormalities of glucose homeostasis and adrenal function. New Eng. J. Med. 333:1386-1390, 1995.
413. Ohagi, S.; Sakaguchi, H.; Sanke, T.; Tatsuta, H.; Hanabusa, T.; Nanjo, K.: Human prohormone convertase 3 gene: exon-intron organization and molecular scanning for mutations in Japanese subjects with NIDDM. Diabetes 45:897-901, 1996.
414. Furuta, M.; Carroll, R.; Martin, S.; Swift, H.; Ravazzola, M.; Orci, L.; Steiner, D.: Incomplete processing of proinsulin to insulin accompanied by elevation of Des-31,32 proinsulin intermediates in islets of mice lacking active PC2. J. Biol. Chem. 273: 3431-3437, 1998.
415. Furuta, M.; Yano, H.; Zhou, A.; Rouille, Y.; Holst, J.; Caroll, R.; Ravazzola, M.; Orci, L.; Furuta, H.; Steiner, D.: Defective prohormone processing and altered pancreatic islet morphology in mice lacking active SPC2. Proc. Nat. Acad. Sci. 94: 6646-6651, 1997.
416. Furuta, M.; Zhou, A.; Webb, G.; Carroll, R.; Ravazzola, M.; Orci, L.; Steiner, D. F.: Severe defect in proglucagon processing in islet A-cells of prohormone convertase 2 null mice. J. Biol. Chem. 276:27197-27202, 2001.
417. Gabreels, B. A. T. F.; Swaab, D. F.; de Kleijn, D. P. V.; Seidah, N. G.; Van de Loo, J.-W.; Van de Ven, W. J. M.; Martens, G. J. M. and van Leeuwen, F. W.: Attenuation of the polypeptide 7B2, prohormone convertase PC2, and vasopressin in the hypothalamus of some Prader-Willi-patients: indications for a processing defect. J. Clin. Endocr. Metab. 83:591-599, 1998.
418. Maglott, D. R.; Feldblyum, T. V.; Durkin, A. S.; Nierman, W. C.: Radiation hybrid mapping of SNAP, PCSK2, and THBD (human chromosome 20p). Mammalian Genome 7: 400-401, 1996.
419. Ohagi, S.; LaMendola, J.; LeBeau, M. M.; Espinosa, R., III; Takeda, J.; Smeekens, S. P.; Chan, S. J.; Steiner, D. F.: Identification and analysis of the gene encoding human PC2, a prohormone convertase expressed in neuroendocrine tissues. Proc. Nat. Acad. Sci. 89: 4977-4981, 1992.
420. Taylor, N. A.; Shennan, K. I. J.; Cutler, D. F.; Docherty, K.: Mutations within the propeptide, the primary cleavage site or the catalytic site, or deletion of C-terminal sequences, prevents secretion of proPC2 from transfected COS-7 cells. Biochem. J. 321: 367-373, 1997.
421. Arbiser, J. L.; Morton, C. C.; Bruns, G. A. P.; Majzoub, J. A.: Human corticotropin releasing hormone gene is located on the long arm of chromosome 8. Cytogenet. Cell Genet. 47: 113-116, 1988.
422. Behan, D. P.; Heinrichs, S. C.; Troncoso, J. C.; Liu, X.-J.; Kawas, C. H.; Ling, N.; De Souza, E. B.: Displacement of corticotropin releasing factor from its binding protein as a possible treatment for Alzheimer's disease. Nature 378: 284-287, 1995.
423. Cheng, Y.-H.; Nicholson, R. C.; King, B.; Chan, E.-C.; Fitter, J. T.; Smith, R.: Corticotropin-releasing hormone gene expression in primary placental cells is modulated by cyclic adenosine 3-prime, 5-prime-monophosphate. J. Clin. Endocr. Metab. 85: 1239-1244, 2000.
424. Habib, K. E.; Weld, K. P.; Rice, K. C.; Pushkas, J.; Champoux, M.; Listwak, S.; Webster, E. L.; Atkinson, A. J.; Schulkin, J.; Contoreggi, C.; Chrousos, G. P.; McCann, S. M.; Suomi, S. J.; Higley, J. D.; Gold, P. W.: Oral administration of a corticotropin-releasing hormone receptor antagonist significantly attenuates behavioral, neuroendocrine, and autonomic responses to stress in primates. Proc. Nat. Acad. Sci. 97:6079-6084, 2000.
425. Inder, W. J.; Prickett, T. C. R.; Ellis, M. J.; Hull, L.; Reid, R.; Benny, P. S.; Livesey, J. H.; Donald, R. A.: The utility of plasma CRH as a predictor of preterm delivery. J. Clin. Endocr. Metab. 86:5706-5710, 2001.
426. Kellogg, J.; Luty, J. A.; Thompson, R.; Luo, X. Y.; Magenis, R. E.; Litt, M.: Corticotropin releasing hormone (CRH) maps to human chromosome 8 and identifies a TaqI RFLP. Cytogenet. Cell Genet. 51:1022, 1989.
427. Knapp, L. T.; Keegan, C. E.; Seasholtz, A. F.; Camper, S. A.: Corticotropin-releasing hormone (Crh) maps to mouse chromosome 3. Mammalian Genome 4: 615-617, 1993.
428. Kyllo, J. H.; Collins, M. M.; Vetter, K. L.; Cuttler, L.; Rosenfield, R. L.; Donohoue, P. A.: Linkage of congenital isolated adrenocorticotropichormone deficiency to the corticotropin releasing hormone locus using simple sequence repeat polymorphisms. Am. J. Med. Genet. 62: 262-267, 1996.
429. Majzoub, J. A.: Personal Communication. Boston, Mass. Mar. 3, 1995.
430. Mandel, H.; Berant, M.; Gotfried, E.; Hochberg, Z.: Autosomal recessive hypothalamic corticotropin deficiency: a new entity and its metabolic consequences. (Abstract) Am. J. Hum. Genet. 47 (suppl.):A66, 1990.
431. McLean, M.; Bisits, A.; Davies, J.; Woods, R.; Lowry, P.; Smith, R.: A placental clock controlling the length of human pregnancy. Nature Med. 1: 460-463, 1995.
432. Muglia, L.; Jacobson, L.; Dikkes, P.; Majzoub, J. A.: Corticotropin-releasing hormone deficiency reveals major fetal but not adult glucocorticoid need. Nature 373: 427-432, 1995.
433. Robinson, B. G.; Emanuel, R. L.; Frim, D. M.; Majzoub, J. A.: Glucocorticoid stimulates expression of corticotropin-releasing hormone gene in human placenta. Proc. Nat. Acad. Sci. 85: 5244-5248, 1988.
434. Scatena, C. D.; Adler, S.: Trans-acting factors dictate the species-specific placental expression of corticotropin-releasing factor genes in choriocarcinoma cell lines. Endocrinology 137: 3000-3008, 1996.
435. Scatena, C. D.; Adler, S.: Characterization of a human-specific regulator of placental corticotropin-releasing hormone. Molec. Endocr. 12:1228-1240, 1998.
436. Shibahara, S.; Morimoto, Y.; Furutani, Y.; Notake, M.; Takahashi, H.; Shimizu, S.; Horikawa, S.; Numa, S.: Isolation and sequence analysis of the human corticotropin-releasing factor precursor gene. EMBO J. 2: 775-779, 1983.
437. Stratakis, C. A.; Chrousos, G. P.: Neuroendocrinology and pathophysiology of the stress system. Ann. N. Y. Acad. Sci. 771: 1-18, 1995.
438. Stratakis, C. A.; Sarlis, N. J.; Berrettini, W. H.; Badner, J. A.; Chrousos, G. P.; Gershon, E. S.; Detera-Wadleigh, S. D.: Lack of linkage between the corticotropin-releasing hormone (CRH) gene and bipolar affective disorder. Molec. Psychiat. 2: 483-485, 1997.
439. Xu, B.; Sano, T.; Yamada, S.; Li, C. C.; Hirokawa, M.: Expression of corticotropin-releasing hormone messenger ribonucleic acid in human pituitary corticotroph adenomas associated with proliferative potential. J. Clin. Endocr. Metab. 85: 1220-1225, 2000.
440. Zouboulis, C. C.; Seltmann, H.; Hiroi, N.; Chen, W.; Young, M.; Oeff, M.; Scherbaum, W. A.; Orfanos, C. E.; McCann, S. M.; Bornstein, S. R.: Corticotropin-releasing hormone: an autocrine hormone that promotes lipogenesis in human sebocytes. Proc. Nat. Acad. Sci. 99:7148-7153, 2002.
441. Chen, R.; Lewis, K. A.; Perrin, M. H.; Vale, W. W.: Expression cloning of a human corticotropin-releasing-factor receptor. Proc. Nat. Acad. Sci. 90: 8967-8971, 1993.
442. Dieterich, K. D.; Gundelfinger, E. D.; Ludecke, D. K.; Lehnert, H.: Mutation and expression analysis of corticotropin-releasing factor 1 receptor in adrenocorticotropin-secreting pituitary adenomas. J. Clin. Endocr. Metab. 83: 3327-3331, 1998.
443. Grammatopoulos, D.; Dai, Y.; Chen, J.; Karteris, E.; Papadopoulou, N.; Easton, A. J.; Hillhouse, E. W.: Human corticotropin-releasing hormone receptor: differences in subtype expression between pregnant and nonpregnant myometria. J. Clin. Endocr. Metab. 83: 2539-2544, 1998.
444. Leproult, R.; Colecchia, E. F.; L'Hermite-Baleriaux, M.; Van Cauter, E.: Transition from dim to bright light in the morning induces an immediate elevation of cortisol levels. J. Clin. Endocr. Metab. 86:151-157, 2001.
445. Liaw, C. W.; Grigoriadis, D. E.; Lovenberg, T. W.; De Souza, E. B.; Maki, R. A.: Localization of ligand-binding domains of human corticotropin-releasing factor receptor: a chimeric receptor approach. Molec. Endocr. 11: 980-985, 1997.
446. Danielson, K. G.; Fazzio, A.; Cohen, I.; Cannizzaro, L. A.; Eichstetter, I.; Iozzo, R. V.: The human decorin gene: intron-exon organization, discovery of two alternatively spliced exons in the 5-prime untranslated region, and mapping of the gene to chromosome 12q23. Genomics 15:146-160, 1993.
447. Dyne, K. M.; Valli, M.; Forlino, A.; Mottes, M.; Kresse, H.; Cetta, G.: Deficient expression of the small proteoglycan decorin in a case of severe/lethal osteogenesis imperfecta. Am. J. Med. Genet. 63:161-166, 1996.
448. Ion, A.; Crosby, A. H.; Kremer, H.; Kenmochi, N.; Van Reen, M.; Fenske, C.; Van Der Burgt, I.; Brunner, H. G.; Montgomery, K.: Detailed mapping, mutation analysis, and intragenic polymorphism identification in candidate Noonan syndrome genes MYL2, DCN, EPS8, and RPL6. J. Med. Genet. 37: 884-886, 2000.
449. McBride, O. W.; Fisher, L. W.; Young, M. F.: Localization of PGI (biglycan, BGN) and PGII (decorin, DCN, PG-40) genes on human chromosomes Xq13-qter and 12q, respectively. Genomics 6: 219-255, 1990.
450. Moscatello, D. K.; Santra, M.; Mann, D. M.; McQuillan, D. J.; Wong, A. J.; Iozzo, R. V.: Decorin suppresses tumor cell growth by activating the epidermal growth factor receptor. J. Clin. Invest. 101: 406-412, 1998.
451. Pulkkinen, L.; Alitalo, T.; Krusius, T.; Peltonen, L.: Expression of decorin in human tissues and cell lines and defined chromosomal assignment of the gene locus (DCN). Cytogenet. Cell Genet. 60: 107-111, 1992.
452. Pulkkinen, L.; Kainulainen, K.; Krusius, T.; Makinen, P.; Schollin, J.; Gustavsson, K.-H.; Peltonen, L.: Deficient expression of the gene coding for decorin in a lethal form of Marfan syndrome. J. Biol. Chem. 265: 17780-17785, 1990.
453. Schollin, J.; Bjarke, B.; Gustavson, K.-H.: Probable homozygotic form of the Marfan syndrome in a newborn child. Acta Paediat. Scand. 77:452-456, 1988.
454. Scholzen, T.; Solursh, M.; Suzuki, S.; Reiter, R.; Morgan, J. L.; Buchberg, A. M.; Siracusa, L. D.; Iozzo, R. V.: The murine decorin: complete cDNA cloning, genomic organization, chromosomal assignment, and expression during organogenesis and tissue differentiation. J. Biol. Chem. 269: 28270-28281, 1994.
455. Vogel, K. G.; Clark, P. E.: Small proteoglycan synthesis by skin fibroblasts cultured from elderly donors and 456. Yoon, J.-W.; Yoon, C.-S.; Lim, H.-W.; Huang, Q. Q.; Kang, Y.; Pyun, K. H.; Hirasawa, K.; Sherwin, R. S.; Jun, H.-S.: Control of autoimmune diabetes in NOD mice by GAD expression or suppression in beta cells. Science 284: 1183-1187, 1999.

457. Asakura, H.; Zwain, I. H.; Yen, S. S. C.: Expression of genes encoding corticotropin-releasing factor (CRF), type 1 CRF receptor, and CRF-binding protein and localization of the gene products in the human ovary. J. Clin. Endocr. Metab. 82: 2720-2725, 1997.

458. Byerley, W.; Hoff, M.; Holik, J.; Caron, M. G.; Giros, B.: VNTR polymorphism for the human dopamine transporter gene (DAT1). Hum. Molec. Genet. 2: 335, 1993.

459. Cook, E. H., Jr.; Stein, M. A.; Krasowski, M. D.; Cox, N. J.; Olkon, D. M.; Kieffer, J. E.; Leventhal, B. L.: Association of attention-deficit disorder and the dopamine transporter gene. Am. J. Hum. Genet. 56:993-998, 1995.

460. Doucette-Stamm, L.; Blakely, D. J.; Tian, J.; Mockus, S.; Mao, J.: Population genetic study of the human dopamine transporter gene (DAT1). Genet. Epidemiol. 12: 303-308, 1995.

461. Gainetdinov, R. R.; Wetsel, W. C.; Jones, S. R.; Levin, E. D.; Jaber, M.; Caron, M. G.: Role of serotonin in the paradoxical calming effect of psychostimulants on hyperactivity. Science 283: 397-401, 1999.

462. Gelernter, J.; Vandenbergh, D.; Kruger, S. D.; Pauls, D. L.; Kurlan, R.; Pakstis, A. J.; Kidd, K. K.; Uhl, G.: The dopamine transporter protein gene (SLC6A3): primary linkage mapping and linkage studies in Tourette syndrome. Genomics 30: 459-463, 1995.

463. Gill, M.; Daly, G.; Heron, S.; Hawi, Z.; Fitgerald, M.: Confirmation of association between attention deficit hyperactivity disorder and a dopamine transporter polymorphism. Molec. Psychiat. 2: 311-313, 1997.

464. Giros, B.; El Mestikawy, S.; Godinot, N.; Zheng, K.; Han, H.; Yang-Feng, T.; Caron, M. G.: Cloning, pharmacological characterization, and chromosome assignment of the human dopamine transporter. Molec. Pharm. 42:383-390, 1992.

465. Giros, B.; Jaber, M.; Jones, S. R.; Wightman, R. M.; Caron, M. G.: Hyperlocomotion and indifference to cocaine and amphetamine in mice lacking the dopamine receptor. Nature 370: 606-612, 1996.

466. Goldman, D.: Dopamine transporter, alcoholism and other diseases. Nature Med. 1: 624-625, 1995.

467. Andrechek, E. R.; Hardy, W. R.; Girgis-Gabardo, A. A.; Perry, R. L. S.; Butler, R.; Graham, F. L.; Kahn, R. C.; Rudnicki, M. A.; Muller, W. J.: ErbB2 is required for muscle spindle and myoblast cell survival. Molec. Cell. Biol. 22: 4714-4722, 2002.

468. Bargmann, C. I.; Hung, M.-C.; Weinberg, R. A.: The NEU oncogene encodes an epidermal growth factor receptor-related protein. Nature 319:226-230, 1986.

469. Chan, R.; Hardy, W. R.; Laing, M. A.; Hardy, S. E.; Muller, W. J.: The catalytic activity of the ErbB-2 receptor tyrosine kinase is essential for embryonic development. Molec. Cell. Biol. 22: 1073-1078, 2002.

470. Coussens, L.; Yang-Feng, T. L.; Liao, Y.-C.; Chen, E.; Gray, A.; McGrath, J.; Seeburg, P. H.; Libermann, T. A.; Schlessinger, J.; Francke, U.; Levinson, A.; Ullrich, A.: Tyrosine kinase receptor with extensive homology to EGF receptor shares chromosomal location with NEU oncogene. Science 230:1132-1139, 1985.

471. Crone, S. A.; Zhao, Y.-Y.; Fan, L.; Gu, Y.; Minamisawa, S.; Liu, Y.; Peterson, K. L.; Chen, J.; Kahn, R.; Condorelli, G.; Ross, J., Jr.; Chien, K. R.; Lee, K.-F.: ErbB2 is essential in the prevention of dilated cardiomyopathy. Nature Med. 8: 459-465, 2002.

472. Dankort, D.; Maslikowski, B.; Warner, N.; Kanno, N.; Kim, H.; Wang, Z.; Moran, M. F.; Oshima, R. G.; Cardiff, R. D.; Muller, W. J.: Grb2 and Shc adapter proteins play distinct roles in Neu (ErbB-2) induced mammary tumorigenesis: implications for human breast cancer. Molec. Cell. Biol. 21: 1540-1551, 2001.

473. De Boer, J. G.: A new mutator phenotype in breast cancer? (Commentary) Proc. Nat. Acad. Sci. 99: 3368-3369, 2002.

474. De Placido, S.; Carlomagno, C.; De Laurentiis, M.; Bianco, A. R.: C-erbB2 expression predicts tamoxifen efficacy in breast cancer patients. Breast Cancer Res. Treat. 52: 55-64, 1998.

475. Di Fiore, P. P.; Pierce, J. H.; Kraus, M. H.; Segatto, O.; King, C. R.; Aaronson, S. A.: erbB-2 is a potent oncogene when overexpressed in NIH/3T3 cells. Science 237: 178-182, 1987.

476. Doherty, J. K.; Bond, C.; Jardim, A.; Adelman, J. P.; Clinton, G. M.: The HER-2/neu receptor tyrosine kinase gene encodes a secreted auto inhibitor. Proc. Nat. Acad. Sci. 96: 10869-10874, 1999.

477. Ehsani, A.; Low, J.; Wallace, R. B.; Wu, A. M.: Characterization of a new allele of the human ERBB2 gene by allele-specific competition hybridization. Genomics 15: 426-429, 1993.

478. Francke, U.: Personal Communication. New Haven, Conn. 4/1988.

479. Fukushige, S.-I.; Matsubara, K.-I.; Yoshida, M.; Sasaki, M.; Suzuki, T.; Semba, K.; Toyoshima, K.; Yamamoto, T.: Localization of a novel v-erbB-related gene, c-erbB-2, on human chromosome 17 and its amplification in a gastric cancer cell line. Molec. Cell. Biol. 6: 955-958, 1986.

480. Kaneko, Y.; Homma, C.; Maseki, N.; Sakurai, M.; Toyoshima, K.; Yamamoto, T.: Human c-erbB-2 remains on chromosome 17 in band q21 in the 15;17 translocation associated with acute promyelocytic leukemia. Jpn. J. Cancer Res. 78: 16-19, 1987.

481. Lin, W.; Sanchez, H. B.; Deerinck, T.; Morris, J. K.; Ellisman, M.; Lee, K. F.: Aberrant development of motor axons and neuromuscular synapses in erbB2-deficient mice. Proc. Nat. Acad. Sci. 97: 1299-1304, 2000.

482. Liu, S.; Liu, W.; Jakubczak, J. L.; Erexson, G. L.; Tindall, K. R.; Chan, R.; Muller, W. J.; Adhya, S.; Garges, S.; Merlino, G.: Genetic instability favoring transversions associated with ErbB2-induced mammary tumorigenesis. Proc. Nat. Acad. Sci. 99: 3770-3775, 2002.

483. Mehta, R. R.; McDermott, J. H.; Hieken, T. J.; Marler, K. C.; Patel, M. K.; Wild, L. D.; Das Gupta, T. K.: Plasma c-erbB2 levels in breast cancer patients: prognostic significance in predicting response to chemotherapy. J. Clin. Oncol. 16: 2409-2416, 1998.

484. Morris, J. K.; Lin, W.; Hauser, C.; Marchuk, Y.; Getman, D.; Lee, K.-F.: Rescue of the cardiac defect in ErbB2 mutant mice reveals essential roles of ErbB2 in peripheral nervous system development. Neuron 23:273-283, 1999.

485. Muleris, M.; Almeida, A.; Malfoy, B.; Dutrillaux, B.: Assignment of v-erb-b2 avian erythroblastic leukemia viral oncogene homolog 2(ERBB2) to human chromosome band 17q21.1 by in situ hybridization. Cytogenet. Cell Genet. 76: 34-35, 1997.

486. Ozcelik, C.; Erdmann, B.; Pilz, B.; Wettschureck, N.; Britsch, S.; Hubner, N.; Chien, K. R.; Birchmeier, C.; Garratt, A. N.: Conditional mutation of the ErbB2 (HER2)

487. Papewalis, J.; Nikitin, A. Y.; Rajewsky, M. F.: G to A polymorphismat amino acid codon 655 of the human erbB-2/HER2 gene. Nucleic Acids Res. 19: 5452 only, 1991.
488. Pegram, M. D.; Finn, R. S.; Arzoo, K.; Beryt, M.; Pietras, R. J.; Slamon, D. J.: The effect of HER-2/neu overexpression on chemotherapeutic drug sensitivity in human breast and ovarian cancer cells. Oncogene 15:537-547, 1997.
489. Pietras, R. J.; Pegram, M. D.; Finn, R. S.; Maneval, D. A.; Slamon, D. J.: Remission of human breast cancer xenografts on therapy with humanized monoclonal antibody to HER-2 receptor and DNA-reactive drugs. Oncogene 17:2235-2249, 1998.
490. Popescu, N. C.; King, C. R.; Kraus, M. H.: Localization of the human erbB-2 gene on normal and rearranged chromosomes 17 to bands q12-21.32. Genomics 4: 362-366, 1989.
491. Qiu, Y.; Ravi, L.; Kung, H.-J.: Requirement of ErbB2 for signalling by interleukin-6 in prostate carcinoma cells. Nature 393: 83-85, 1998.
492. Semba, K.; Kamata, N.; Toyoshima, K.; Yamamoto, T.: A v-erbB-related protooncogene, c-erbB-2, is distinct from the c-erbB-1/epidermal growth factor-receptor gene and is amplified in a human salivary gland adenocarcinoma. Proc. Nat. Acad. Sci. 82: 6497-6501, 1985.
493. Slamon, D. J.; Godolphin, W.; Jones, L. A.; Holt, J. A.; Wong, S. G.; Keith, D. E.; Levin, W. J.; Stuart, S. G.; Udove, J.; Ullrich, A.; Press, M. F.: Studies of the HER-2/neu proto-oncogene in human breast and ovarian cancer. Science 244: 707-712, 1989.
494. Slamon, D. J.; Leyland-Jones, B.; Shak, S.; Fuchs, H.; Paton, V.; Bajamonde, A.; Fleming, T.; Eiermann, W.; Wolter, J.; Pegram, M.; Baselga, J.; Norton, L.: Use of chemotherapy plus a monoclonal antibody against HER2 for metastatic breast cancer that overexpresses HER2. New Eng. J. Med. 344: 783-792, 2001.
495. Scita, G.; Nordstrom, J.; Carbone, R.; Tenca, P.; Giardina, G.; Gutkind, S.; Bjarnegard, M.; Betsholtz, C.; Di Fiore, P. P.: EPS8 and E3B1 transduce signals from Ras to Rac. Nature 401: 290-293, 1999.
496. Zuniga, A.; Haramis, A.-P. G.; McMahon, A. P.; Zeller, R.: Signal relay by BMP antagonism controls the SHH/FGF4 feedback loop in vertebrate limb buds. Nature 401: 598-602, 1999.
497. Heine, P. A.; Taylor, J. A.; Iwamoto, G. A.; Lubahn, D. B.; Cooke, P. S.: Increased adipose tissue in male and female estrogen receptor-alpha knockout mice. Proc. Nat. Acad. Sci. 97: 12729-12734, 2000.
498. Cook, P. J. L.; Hamerton, J. L.: Report of the committee on the genetic constitution of chromosome 1. Cytogenet. Cell Genet. 25:9-20, 1979.
499. Karasawa, M.; Zwacka, R. M.; Reuter, A.; Fink, T.; Hsieh, C. L.; Lichter, P.; Francke, U.; Weiher, H.: The human homolog of the glomerulosclerosis gene Mpv17: structure and genomic organization. Hum. Molec. Genet. 2:1829-1834, 1993.
500. Boyes, J.; Bird, A.: DNA methylation inhibits transcription indirectly via a methyl-CpG binding protein. Cell 64: 1123-1134, 1991.
501. Cross, S. H.; Meehan, R. R.; Nan, X.; Bird, A.: A component of the transcriptional repressor MeCP1 shares a motif with DNA methyltransferase and HRX proteins. Nature Genet. 16: 256-259, 1997.
502. Hendrich, B.; Abbott, C.; McQueen, H.; Chambers, D.; Cross, S.; Bird, A.: Genomic structure and chromosomal mapping of the murine and human Mbd1, Mbd2, Mbd3, and Mbd4 genes. Mammalian Genome 10:906-912, 1999.
503. Beauchemin, N.; Draber, P.; Dveksler, G.; Gold, P.; Gray-Owen, S.; Grunert, F.; Hammarstrom, S.; Holmes, K. V.; Karlsson, A.; Kuroki, M.; Lin, S.-H.; Lucka, L.; and 13 others: Redefined nomenclature for members of the carcinoembryonic antigen family. Exp. Cell Res. 252:243-249, 1999.
504. Compton, D. A.; Szilak, I.; Cleveland, D. W.: Primary structure of NuMA, an intranuclear protein that defines a novel pathway for segregation of proteins at mitosis. J. Cell Biol. 116: 1395-1408, 1992.
505. Lydersen, B. K.; Pettijohn, D. E.: Human-specific nuclear protein that associates with the polar region of the mitotic apparatus: distribution in a human/hamster hybrid cell. Cell 22: 489-499, 1980.
506. Merdes, A.; Ramyar, K.; Vechio, J. D.; Cleveland, D. W.: A complex of NuMA and cytoplasmic dynein is essential for mitotic spindle assembly. Cell 87:447-458, 1996.
507. Sparks, C. A.; Bangs, P. L.; McNeil, G. P.; Lawrence, J. B.; Fey, E. G.: Assignment of the nuclear mitotic apparatus protein NuMA gene to human chromosome 11q13. Genomics 17: 222-224, 1993.
508. Wells, R. A.; Catzavelos, C.; Kamel-Reid, S.: Fusion of retinoic acid receptor alpha to NuMA, the nuclear mitotic apparatus protein, by a variant translocation in acute promyelocytic leukaemia. Nature Genet. 17: 109-113, 1997.
509. Wiese, C.; Wilde, A.; Moore, M. S.; Adam, S. A.; Merdes, A.; Zheng, Y.: Role of importin-beta in coupling Ran to downstream targets in microtubule assembly. Science 291: 653-656, 2001.
510. Yang, C. H.; Lambie, E. J.; Snyder, M.: NuMA: an unusually long coiled-coil related protein in the mammalian nucleus. J. Cell Biol. 116:1303-1317, 1992.
511. Nomura, N.; Nagase, T.; Miyajima, N.; Sazuka, T.; Tanaka, A.; Sato, S.; Seki, N.; Kawarabayasi, Y.; Ishikawa, K.; Tabata, S.: Prediction of the coding sequences of unidentified human genes. II. The coding sequences of 40 new genes (KIAA0041-KIAA0080) deduced by analysis of cDNA clones from human cell line KG-1. DNA Res. 1: 223-229, 1994.
512. Bezieau, S.; Devilder, M.-C.; Avet-Loiseau, H.; Mellerin, M.-P.; Puthier, D.; Pennarun, E.; Rapp, M.-J.; Harousseau, J.-L.; Moisan, J.-P.; Bataille, R.: High incidence of N and K-Ras activating mutations in multiple myeloma and primary plasma cell leukemia at diagnosis. Hum. Mutat. 18: 212-224, 2001.
513. Popescu, N. C.; Amsbaugh, S. C.; DiPaolo, J. A.; Tronick, S. R.; Aaronson, S. A.; Swan, D. C.: Chromosomal localization of three human ras genes by in situ molecular hybridization. Somat. Cell Molec. Genet. 11: 149-155, 1985.
514. Maggi, M.; Barni, T.; Fantoni, G.; Mancina, R.; Pupilli, C.; Luconi, M.; Crescioli, C.; Serio, M.; Vannelli, G. B.: Expression and biological effects of endothelin-1 in human gonadotropin-releasing hormone-secreting neurons. J. Clin. Endocr. Metab. 85: 1658-1665, 2000.
515. Okafor, M. C.; Delamere, N. A.: The inhibitory influence of endothelin on active sodium-potassium transport in porcine lens. Invest. Ophthal. Vis. Sci. 42: 1018-1023, 2001.
516. Zeidel, M. L.; Brady, H. R.; Kone, B. C.; Gullans, S. R.; Brenner, B. M.: Endothelin, a peptide inhibitor of Na(+)-K(+)-ATPase in intactrenal tubular epithelial cells. Am. J. Physiol. 257: C1101-C1107, 1989.
517. Lerman, C.; Caporaso, N. E.; Audrain, J.; Main, D.; Bowman, E. D.; Lockshin, B.; Boyd, N. R.; Shields, P. G.:

Evidence suggesting the role of specific genetic factors in cigarette smoking. Health Psych. 18: 14-20, 1999.

518. Lossie, A. C.; Vandenbergh, D. J.; Uhl, G. R.; Camper, S. A.: Localization of the dopamine transporter gene, Dat1, on mouse chromosome 519. Mammalian Genome 5: 117-118, 1994.13. Sabol, S. Z.; Nelson, M. L.; Fisher, C.; Gunzerath, L.; Brody, C. L.; Hu, S.; Sirota, L. A.; Marcus, S. E.; Greenberg, B. D.; Lucas, F. R., IV; Benjamin, J.; Murphy, D. L.; Hamer, D. H.: A genetic association for cigarette smoking behavior. Health Psych. 18: 7-13, 1999.

520. Tiihonen, J.; Kuikka, J.; Bergstrom, K.; Hakola, P.; Karhu, J.; Ryynanen, O.-P.; Fohr, J.: Altered striatal dopamine re-uptake site densities in habitually violent and non-violent alcoholics. Nature Med. 1: 654-657, 1995.

521. Vandenbergh, D. J.; Persico, A. M.; Hawkins, A. L.; Griffin, C. A.; Li, X.; Jabs, E. W.; Uhl, G. R.: Human dopamine transporter gene (DAT1) maps to chromosome 5p15.3 and displays a VNTR. Genomics 14:1104-1106, 1992.

522. Vandenbergh, D. J.; Persico, A. M.; Uhl, G. R.: A human dopamine transporter cDNA predicts reduced glycosylation, displays a novel repetitive element and provides racially-dimorphic TaqI RFLPs. Molec. Brain Res. 15: 161-166, 1992.

523. Waldman, I. D.; Rowe, D. C.; Abramowitz, A.; Kozel, S. T.; Mohr, J. H.; Sherman, S. L.; Cleveland, H. H.; Sanders, M. L.; Gard, J. M. C.; Stever, C.: Association and linkage of the dopamine transporter gene and attention-deficit hyperactivity disorder in children: heterogeneity owing to diagnostic subtype and severity. Am. J. Hum. Genet. 63:1767-1776, 1998.

524. von Boehmer, H.; Sarukhan, A.: GAD, a single autoantigen for diabetes. Science 284: 1135-1136, 1999.

525. McGill, G. G.; Horstmann, M.; Widlund, H. R.; Du, J.; Motyckova, G.; Nishimura, E. K.; Lin, Y.-L.; Ramaswamy, S.; Avery, W.; Ding, H.-F.; Jordan, S. A.; Jackson, I. J.; Korsmeyer, S. J.; Golub, T. R.; Fisher, D. E.: Bcl2 regulation by the melanocyte master regulator Mitf modulates lineage survival and melanoma cell viability. Cell 109:707-718, 2002.

526. Geck, P.; Sonnenschein, C.; Soto, A. M.: The D13S171 marker, misannotated to BRCA2, links the AS3 gene to various cancers. (Letter) Am. J. Hum. Genet. 69: 461-463, 2001.

527. Geck, P.; Szelei, J.; Jimenez, J.; Sonnenschein, C.; Soto, A. M.: Early gene expression during androgen-induced inhibition of proliferation of prostate cancer cells: a new suppressor candidate on chromosome 13, in the BRCA2-Rb1 locus. J. Steroid Biochem. Molec. Biol. 68:41-50, 1999.

528. Okazaki, I.; Kinoshita, K.; Muramatsu, M.; Yoshikawa, K.; Honjo, T.: The AID enzyme induces class switch recombination in fibroblasts. Nature 416:340-345, 2002.

529. Petersen-Mahrt, S. K.; Harris, R. S.; Neuberger, M. S.: AID mutates *E. coli* suggesting a DNA deamination mechanism for antibody diversification. Nature 418:99-104, 2002.

530. Revy, P.; Muto, T.; Levy, Y.; Geissmann, F.; Plebani, A.; Sanal, O.; Catalan, N.; Forveille, M.; Dufourcq-Lagelouse, R.; Gennery, A.; Tezcan, I.; Ersoy, F.; and 9 others: Activation-induced cytidinedeaminase (AID) deficiency causes the autosomal recessive form of the hyper-IgM syndrome (HIGM2). Cell 102: 565-575, 2000.

531. Yoshikawa, K.; Okazaki, I.; Eto, T.; Kinoshita, K.; Muramatsu, M.; Nagaoka, H.; Honjo, T.: AID enzyme-induced hypermutation in an actively transcribed gene in fibroblasts. Science 296: 2033-2036, 2002.

532. Tamari, M.; Daigo, Y.; Nakamura, Y.: Isolation and characterization of a novel serine threonine kinase gene on chromosome 3q22-21.3. J. Hum. Genet. 44: 116-120, 1999.

533. Tamari, M.; Daigo, Y.; Ishikawa, S.; Nakamura, Y.: Genomic structure of a novel human gene (XYLB) on chromosome 3p22-p21.3 encoding a xylulokinase-like protein. Cytogenet. Cell Genet. 82: 101-104, 1998.

534. Hertzel, A. V.; Bernlohr, D. A.: Cloning and chromosomal location of the murine keratinocyte lipid-binding protein gene. Gene 221:235-243, 1998.

535. Madsen, P.; Rasmussen, H. H.; Leffers, H.; Honore, B.; Celis, J. E.: Molecular cloning and expression of a novel keratinocyte protein (psoriasis-associated fatty acid-binding protein [PA-FABP]) that is highly up-regulated in psoriatic skin and that shares similarity to fatty acid-binding proteins. J. Invest. Derm. 99: 299-305, 1992.

536. Siegenthaler, G.; Hotz, R.; Chatellard-Gruaz, D.; Didierjean, L.; Hellman, U.; Saurat, J. H.: Purification and characterization of the human epidermal fatty acid-binding protein: localization during epidermal cell differentiation in vivo and in vitro. Biochem J. 302:363-371, 1994.

537. Polyak, K.; Xia, Y.; Zweier, J. L.; Kinzler, K. W.; Vogelstein, B.: A model for p53-induced apoptosis. Nature 389: 300-305, 1997.

538. Hernandez, M.-C.; Andres-Barquin, P. J.; Holt, I.; Israel, M. A.: Cloning of human ENC-1 and evaluation of its expression and regulation in nervous system tumors. Exp. Cell Res. 242: 470-477, 1998.

539. Hernandez, M.-C.; Andres-Barquin, P. J.; Israel, M. A.: Assignment of the ectodermal-neural cortex 1 gene (Enc1) to mouse chromosome band 13D1 by fluorescence in situ hybridization. Cytogenet. Cell Genet. 89: 158-159, 2000.

540. Hernandez, M.-C.; Andres-Barquin, P. J.; Kuo, W. L.; Israel, M. A.: Assignment of the ectodermal-neural cortex 1 gene (ENC1) to human chromosome band 5q13 by in situ hybridization. Cytogenet. Cell Genet. 87:89-90, 1999.

541. Kim, T.-A.; Lim, J.; Ota, S.; Raja, S.; Rogers, R.; Rivnay, B.; Avraham, H.; Avraham, S.: NRP/B, a novel nuclear matrix protein, associates with p110(RB) and is involved in neuronal differentiation. J. Cell Biol. 141: 553-566, 1998.

542. Christopoulos, G.; Perry, K. J.; Morfis, M.; Tilakaratne, N.; Gao, Y.; Fraser, N. J.; Main, M. J.; Foord, S. M.; Sexton, P. M.: Multiple amylin receptors arise from receptor activity-modifying protein interaction with the calcitonin receptor gene product. Molec. Pharm. 56: 235-242, 1999.

543. de Vernejoul, M.-C.: Personal Communication. Paris, France Jan. 19, 1999.

544. Gorn, A. H.; Lin, H. Y.; Yamin, M.; Auron, P. E.; Flannery, M. R.; Tapp, D. R.; Manning, C. A.; Lodish, H. F.; Krane, S. M.; Goldring, S. R.: Cloning, characterization, and expression of a human calcitonin receptor from an ovarian carcinoma cell line. J. Clin. Invest. 90:1726-1735, 1992.

545. Bundey, S.: Recent views on genetic factors in retinoblastoma. (Abstract) J. Med. Genet. 17: 386-387, 1980.

546. Bundey, S.; Morten, J. E. N.: An unusual pedigree with retinoblastoma. Does it shed light on the delayed mutation and host resistance theories? Hum. Genet. 59: 434-436, 1981.

547. Cance, W. G.; Brennan, M. F.; Dudas, M. E.; Huang, C.-M.; Cordon-Cardo, C.: Altered expression of the retinoblastoma gene product in human sarcomas. New Eng. J. Med. 323: 1457-1462, 1990.

548. Canning, S.; Dryja, T. P.: Short, direct repeats at the breakpoints of deletions of the retinoblastoma gene. Proc. Nat. Acad. Sci. 86:5044-5048, 1989.
549. Carlson, E. A.; Desnick, R. J.: Mutational mosaicism and genetic counseling in retinoblastoma. Am. J. Med. Genet. 4: 365-381, 1979.
550. Cavenee, W. K.: The genetic basis of neoplasia: the retinoblastoma paradigm. Trends Genet. 2: 299-300, 1986.
551. Cavenee, W. K.; Dryja, T. P.; Phillips, R. A.; Benedict, W. F.; Godbout, R.; Gallie, B. L.; Murphree, A. L.; Strong, L. C.; White, R. L.: Expression of recessive alleles by chromosomal mechanisms in retinoblastoma. Nature 305: 779-784, 1983.
552. Cavenee, W. K.; Hansen, M. F.; Nordenskjold, M.; Kock, E.; Maumenee, I.; Squire, J. A.; Phillips, R. A.; Gallie, B. L.: Genetic origin of mutations predisposing to retinoblastoma. Science 228: 501-503, 1985.
553. Cavenee, W. K.; Murphree, A. L.; Shull, M. M.; Benedict, W. F.; Sparkes, R. S.; Kock, E.; Nordenskjold, M.: Prediction of familial predisposition to retinoblastoma. New Eng. J. Med. 314: 1201-1207, 1986.
554. Chano, T.; Ikegawa, S.; Kontani, K.; Okabe, H.; Baldini, N.; Saeki, Y.: Identification of RB1CC1, a novel human gene that can induce RB1 in various human cells. Oncogene 21: 1295-1298, 2002.
555. Chauveinc, L.; Mosseri, V.; Quintana, E.; Desjardins, L.; Schlienger, P.; Doz, F.; Dutrillaux, B.: Osteosarcoma following retinoblastoma: age at onset and latency period. Ophthalmic Genet. 22: 77-88, 2001.
556. Chen, P.-L.; Scully, P.; Shew, J.-Y.; Wang, J. Y. J.; Lee, W.-H.: Phosphorylation of the retinoblastoma gene product is modulated during the cell cycle and cellular differentiation. Cell 58: 1193-1198, 1989.
557. Connolly, M. J.; Payne, R. H.; Johnson, G.; Gallie, B. L.; Allderdice, P. W.; Marshall, W. H.; Lawton, R. D.: Familial, EsD-linked, retinoblastoma with reduced penetrance and variable expressivity. Hum. Genet. 65:122-124, 1983.
558. Cowell, J. K.; Bia, B.: A novel missense mutation in patients from a retinoblastoma pedigree showing only mild expression of the tumor phenotype. Oncogene 16: 3211-3213, 1998.
559. Cowell, J. K.; Rutland, P.; Hungerford, J.; Jay, M.: Deletion of chromosome region 13q14 is transmissible and does not always predispose to retinoblastoma. Hum. Genet. 80: 43-45, 1988.
560. Cowell, J. K.; Rutland, P.; Jay, M.; Hungerford, J.: Deletions of the esterase D locus from a survey of 200 retinoblastoma patients. Hum. Genet. 72: 164-167, 1986.
561. Cowell, J. K.; Smith, T.; Bia, B.: Frequent constitutional C to T mutations in CGA-arginine codons in the RB1 gene produce premature stop codons in patients with bilateral (hereditary) retinoblastoma. Europ. J. Hum. Genet. 2: 281-290, 1994.
562. Dahiya, A.; Wong, S.; Gonzalo, S.; Gavin, M.; Dean, D. C.: Linking the Rb and Polycomb pathways. Molec. Cell 8: 557-568, 2001.
563. Davison, E. V.; Gibbons, B.; Aherne, G. E. S.; Roberts, D. F.: Chromosomes in retinoblastoma patients. Clin. Genet. 15: 505-508, 1979.
564. DeCaprio, J. A.; Ludlow, J. W.; Lynch, D.; Furukawa, Y.; Griffin, J.; Piwnica-Worms, H.; Huang, C.-M.; Livingston, D. M.: The product of the retinoblastoma susceptibility gene has properties of a cell cycle regulatory element. Cell 58: 1085-1095, 1989.
565. de Grouchy, J.; Turleau, C.; Cabanis, M. O.; Richardet, J. M.: Retinoblastome et deletion intercalaire du chromosome 13. Arch. Franc. Pediat. 37: 531-535, 1980.
566. Dryja, T.; Cavenee, W.; Epstein, J.; Rapaport, J.; Goorin, A.; Koufos, A.: Chromosome 13 homozygosity in osteogenic sarcoma without retinoblastoma. (Abstract) Am. J. Hum. Genet. 36: 28S, 1984.
567. Dryja, T. P.; Bruns, G. A. P.; Gallie, B.; Petersen, R.; Green, W.; Rapaport, J. M.; Albert, D. M.; Gerald, P. S.: Low incidence of deletion of the esterase D locus in retinoblastoma patients. Hum. Genet. 64: 151-155, 1983.
568. Dryja, T. P.; Cavenee, W.; White, R.; Rapaport, J. M.; Petersen, R.; Albert, D. M.; Bruns, G. A. P.: Homozygosity of chromosome 13 in retinoblastoma. New Eng. J. Med. 310: 550-553, 1984.
569. Dryja, T. P.; Friend, S.; Weinberg, R. A.: Isolation of a cDNA fragment derived from human retina mRNA which detects a locus within 13q14 often deleted in retinoblastomas. (Abstract) Am. J. Hum. Genet. 39:A29, 1986.
570. Dryja, T. P.; Mukai, S.; Petersen, R.; Rapaport, J. M.; Walton, D.; Yandell, D. W.: Parental origin of mutations of the retinoblastoma gene. Nature 339: 556-558, 1989.
571. Dryja, T. P.; Mukai, S.; Rapaport, J. M.; Yandell, D. W.: Parental origin of mutations of the retinoblastoma gene. (Abstract) Am. J. Hum. Genet. 45 (suppl.): A19, 1989.
572. Clinton, M.; Frangou-Lazaridis, M.; Panneerselvam, C.; Horecker, B. L.: The sequence of human parathymosin deduced from a cloned human kidney cDNA. Biochem. Biophys. Res. Commun. 158: 855-862, 1989.
573. Szabo, P.; Clinton, M.; Macera, M.; Horecker, B. L.: Localization of the gene coding for parathymosin to chromosome 17 in humans. Cytogenet. Cell Genet. 50: 91-92, 1989.
574. Carvajal, J. J.; Pook, M. A.; dos Santos, M.; Doudney, K.; Hillermann, R.; Minogue, S.; Williamson, R.; Hsuan, J. J.; Chamberlain, S.: The Friedreich's ataxia gene encodes a novel phosphatidylinositol-4-phosphate5-kinase. Nature Genet. 14: 157-162, 1996.
575. Carvajal, J. J.; Pook, M. A.; Doudney, K.; Hillermann, R.; Wilkes, D.; Al-Mahdawi, S.; Williamson, R.; Chamberlain, S.: Friedreich's ataxia: a defect in signal transduction? Hum. Molec. Genet. 4: 1411-1419, 1995.
576. Pook, M. A.; Carvajal, J. J; Doudney, K.; Hillermann, R.; Chamberlain, S.: Exon-intron structure of a 2.7-kb transcript of the STM7 gene with phosphatidylinositol-4-phosphate 5-kinase activity. Genomics 42:170-172, 1997.
577. Plougastel, B.; Trowsdale, J.: Cloning of NKG2-F, a new member of the NKG2 family of human natural killer cell receptor genes. Europ. J. Immun. 27: 2835-2839, 1997.
578. Sutherland, C. L.; Chalupny, N. J.; Schooley, K.; VandenBos, T.; Kubin, M.; Cosman, D.: UL16-binding proteins, novel MHC class I-related proteins, bind to NKG2D and activate multiple signaling pathways in primary NK cells. J. Immun. 168: 671-679, 2002.
579. Wu, J.; Song, Y.; Bakker, A. B. H.; Bauer, S.; Spies, T.; Lanier, L. L.; Phillips, J. H.: An activating immunoreceptor complex formed by NKG2D and DAP10. Science 285: 730-732, 1999.
580. Volkmer, E.; Karnitz, L. M.: Human homologs of Schizosaccharomyces pombe Rad1, Hus1, and Rad9 form a DNA damage-responsive protein complex. J. Biol. Chem. 274: 567-570, 1999.
581. Hacker, B. M.; Tomlinson, J. E.; Wayman, G. A.; Sultana, R.; Chan, G.; Villacres, E.; Disteche, C.; Storm, D. R.: Cloning, chromosomal mapping, and regulatory properties of the human type 9 adenylyl cyclase (ADCY9). Genomics 50: 97-104, 1998.
582. Paterson, J. M.; Smith, S. M.; Harmar, A. J.; Antoni, F. A.: Control of a novel adenylyl cyclase by calcineurin. Biochem. Biophys. Res. Commun. 214: 1000-1008, 1995.

583. Premont, R. T.; Matsuoka, I.; Mattei, M. G.; Pouille, Y.; Defer, N.; Hanoune, J.: Identification and characterization of a widely expressed form of adenylyl cyclase. J. Biol. Chem. 271: 13900-13907, 1996.

584. Toyota, T.; Hattori, E.; Meerabux, J.; Yamada, K.; Saito, K.; Shibuya, H.; Nankai, M.; Yoshikawa, T.: Molecular analysis, mutation screening, and association study of adenylate cyclase type 9 gene (ADCY9) in mood disorders. Am. J. Med. Genet. (Neuropsychiat. Genet.) 114:84-92, 2002.

585. Amiel, J.; Salomon, R.; Attie, T.; Pelet, A.; Trang, H.; Mokhtari, M.; Gaultier, C.; Munnich, A.; Lyonnet, S.: Mutations of the RET-GDNF signaling pathway in Ondine's curse. (Letter) Am. J. Hum. Genet. 62:715-717, 1998.

586. Angrist, M.; Bolk, S.; Thiel, B.; Puffenberger, E. G.; Hofstra, R. M.; Buys, C. H. C. M.; Cass, D. T.; Chakravarti, A.: Mutation analysis of the RET receptor tyrosine kinase in Hirsch sprung disease. Hum. Molec. Genet. 4: 821-830, 1995.

587. Antinolo, G.; Marcos, I.; Fernandez, R. M.; Romero, M.; Borrego, S.: A novel germline point mutation, c.2304G (T, in codon 768 of the RET proto-oncogene in a patient with medullary thyroid carcinoma. (Letter) Am. J. Med. Genet. 110: 85-87, 2002.

588. Attie, T.; Pelet, A.; Edery, P.; Eng, C.; Mulligan, L. M.; Amiel, J.; Boutrand, L.; Beldjord, C.; Nihoul-Fekete, C.; Munnich, A.; Ponder, B. A. J.; Lyonnet, S.: Diversity of RET proto-oncogene mutations in familial and sporadic Hirsch sprung disease. Hum. Molec. Genet. 4:1381-1386, 1995.

589. Attie-Bitach, T.; Abitbol, M.; Gerard, M.; Delezoide, A.-L.; Auge, J.; Pelet, A.; Amiel, J.; Pachnis, V.; Munnich, A.; Lyonnet, S.; Vekemans, M.: Expression of the RET proto-oncogene in human embryos. Am. J. Med. Genet. 80: 481-486, 1998.

590. Auricchio, A.; Griseri, P.; Carpentieri, M. L.; Betsos, N.; Staiano, A.; Tozzi, A.; Priolo, M.; Thompson, H.; Bocciardi, R.; Romeo, G.; Ballabio, A.; Ceccherini, I.: Double heterozygosity for a RET substitution interfering with splicing and an EDNRB missense mutation in Hirschsprung disease. (Letter) Am. J. Hum. Genet. 64: 1216-1221, 1999.

591. Batourina, E.; Choi, C.; Paragas, N.; Bello, N.; Hensle, T.; Costantini, F. D.; Schuchardt, A.; Bacallao, R. L.; Mendelsohn, C. L.: Distalureter morphogenesis depends on epithelial cell remodeling mediated by vitamin A and Ret. Nature Genet. 32: 109-115, 2002. Note: Erratum: Nature Genet. 32: 331 only, 2002.

592. Batourina, E.; et al; et al: Vitamin A controls epithelial/mesenchymal interactions through Ret expression. Nature Genet. 27: 74-78, 2001.

593. Berndt, I.; Reuter, M.; Saller, B.; Frank-Raue, K.; Groth, P.; Grubendorf, M.; Raue, F.; Ritter, M. M.; Hoppner, W.: A new hot spot for mutations in the ret protooncogene causing familial medullary thyroid carcinoma and multiple endocrine neoplasia type 2A. J. Clin. Endocr. Metab. 83: 770-774, 1998.

594. Boccia, L. M.; Green, J. S.; Joyce, C.; Eng, C.; Taylor, S. A. M.; Mulligan, L. M.: Mutation of RET codon 768 is associated with the FMTC phenotype. Clin. Genet. 51: 81-85, 1997.

595. Bolino, A.; Schuffenecker, I.; Luo, Y.; Seri, M.; Silengo, M.; Tocco, T.; Chabrier, G.; Houdent, C.; Murat, A.; Schlumberger, M.; Tourniaire, J.; Lenoir, G. M.; Romeo, G.: RET mutations in exons 13 and 14 of FMTC patients. Oncogene 10: 2415-2419, 1995.

596. Bolk, S.; Angrist, M.; Schwartz, S.; Silvestri, J. M.; Weese-Mayer, D. E.; Chakravarti, A.: Congenital central hypoventilation syndrome: mutation analysis of the receptor tyrosine kinase RET. Am. J. Med. Genet. 63: 603-609, 1996.

597. Bolk Gabriel, S.; Salomon, R.; Pelet, A.; Angrist, M.; Amiel, J.; Formage, M.; Attie-Bitach, T.; Olson, J. M.; Hofstra, R.; Buys, C.; Steffann, J.; Munnich, A.; Lyonnet, S.; Chakravarti, A.: Segregation at three loci explains familial and population risk in Hirschsprung disease. Nature Genet. 31: 89-93, 2002.

598. Ceccherini, I.; Hofstra, R. M.; Luo, Y.; Stulp, R. P.; Barone, V.; Stelwagen, T.; Bocciardi, R.; Nijveen, H.; Bolino, A.; Seri, M.; Ronchetto, P.; Pasini, B.; Bozzano, M.; Buys, C. H. C. M.; Romeo, G.: DNA polymorphisms and conditions for SSCP analysis of the 20 exons of the Ret proto-oncogene. Oncogene 9: 3025-3029, 1994.

599. Navab, M.; Hama-Levy, S.; Van Lenten, B. J.; Fonarow, G. C.; Cardinez, C. J.; Castellani, L. W.; Brennan, M.-L.; Lusis, A. J.; Fogelman, A. M.: Mildly oxidized LDL induces an increased apolipoprotein J/paraoxonase ratio. J. Clin. Invest. 99: 2005-2019, 1997.

600. Houchins, J. P.; Yabe, T.; McSherry, C.; Bach, F. H.: DNA sequence analysis of NKG2, a family of related cDNA clones encoding type II integral membrane proteins on human natural killer cells. J. Exp. Med. 173: 1017-1020, 1991.

601. Plougastel, B.; Trowsdale, J.: Sequence analysis of a 62-kb region overlapping the human KLRC cluster of genes. Genomics 49: 193-199, 1998.

602. Yabe, T.; McSherry, C.; Bach, F. H.; Fisch, P.; Schall, R. P.; Sondel, P. M.; Houchins, J. P.: A multigene family on human chromosome 12 encodes natural killer-cell lectins. Immunogenetics 37: 455-460, 1993.

603. Rousseau-Merck, M.-F.; Zahraoui, A.; Touchot, N.; Tavitian, A.; Berger, R.: Chromosome assignment of four RAS-related RAB genes. Hum. Genet. 86: 350-354, 1991.

604. Li, F. P.; Decker, H.-J. H.; Zbar, B.; Stanton, V. P., Jr.; Kovacs, G.; Seizinger, B. R.; Aburatani, H.; Sandberg, A. A.; Berg, S.; Hosoe, S.; Brown, R. S.: Clinical and genetic studies of renal cell carcinomas in a family with a constitutional chromosome 3;8 translocation: genetics of familial renal carcinoma. Ann. Intern. Med. 118: 106-111, 1993.

605. Ohta, M.; Inoue, H.; Cotticelli, M. G.; Kastury, K.; Baffa, R.; Palazzo, J.; Siprashvili, Z.; Mori, M.; McCue, P.; Druck, T.; Croce, C. M.; Huebner, K.: The FHIT gene, spanning the chromosome 3p14.2 fragile site and renal carcinoma-associated t(3;8) breakpoint, is abnormal in digestive tract cancers. Cell 84: 587-597, 1996.

606. Puffenberger, E. G.; Hosoda, K.; Washington, S. S.; Nakao, K.; deWit, D.; Yanagisawa, M.; Chakravarti, A.: A missense mutation of the endothelin-B receptor gene in multigenic Hirschsprung's disease. Cell 79:1257-1266, 1994.

607. Svensson, P.-J.; Anvret, M.; Molander, M.-L.; Nordenskjold, A.: Phenotypic variation in a family with mutations in two Hirschsprung-related genes (RET and endothelin receptor B). Hum. Genet. 103: 145-148, 1998.

608. Hanks, M.; Wurst, W.; Anson-Cartwright, L.; Auerbach, A. B.; Joyner, A. L.: Rescue of the En-1 mutant phenotype by replacement of En-1 with En-2. Science 269: 679-682, 1995.

609. Johnson, R. L.; Tabin, C. J.: Molecular models for vertebrate limb development. Cell 90: 979-990, 1997.

610. Salmeen, A.; Andersen, J. N.; Myers, M. P.; Tonks, N. K.; Barford, D.: Molecular basis for the dephosphorylation of 611. Polymeropoulos, M. H.; Torres, R.; Yanovski, J. A.; Chandrasekharappa, S. C.; Ledbetter, D. H.: The human corticotropin-releasing factor receptor (CRHR) gene maps to chromosome 17q12-q22. Genomics 28:123-124, 1995.

612. Sakai, K.; Yamada, M.; Horiba, N.; Wakui, M.; Demura, H.; Suda, T.: The genomic organization of the human corticotropin-releasing factor type-1 receptor. Gene 219: 125-130, 1998.

613. Sillaber, I.; Rammes, G.; Zimmermann, S.; Mahal, B.; Zieglgansberger, W.; Wurst, W.; Holsboer, F.; Spanagel, R.: Enhanced and delayed stress-induced alcohol drinking in mice lacking functional CRH1 receptors. Science 296: 931-933, 2002.

614. Smith, G. W.; Aubry, J.-M.; Dellu, F.; Contarino, A.; Bilezikjian, L. M.; Gold, L. H.; Chen, R.; Marchuk, Y.; Hauser, C.; Bentley, C. A.; Sawchenko, P. E.; Koob, G. F.; Vale, W.; Lee, K.-F.: Corticotropin releasing factor receptor 1-deficient mice display decreased anxiety, impaired stress response, and aberrant neuroendocrine development. Neuron 20:1093-1102, 1998.

615. Timpl, P.; Spanagel, R.; Sillaber, I.; Kresse, A.; Reul, J. M. H. M.; Stalla, G. K.; Blanquet, V.; Steckler, T.; Holsboer, F.; Wurst, W.: Impaired stress response and reduced anxiety in mice lacking a functional corticotropin-releasing hormone receptor 1. Nature Genet. 19:162-166, 1998.

616. Brissenden, J. E.; Derynck, R.; Francke, U.: Transforming growth factor alpha gene (TGFA) maps to human chromosome 2 close to the breakpoint of the t(2;8) variant translocation in Burkitt lymphoma. (Abstract) Cytogenet. Cell Genet. 40: 589 only, 1985.

617. Collin, G. B.; Marshall, J. D.; Naggert, J. K.; Nishina, P. M.: TGFA: exon-intron structure and evaluation as a candidate gene for Alstrom syndrome. (Letter) Clin. Genet. 55: 61-62, 1999.

618. Ellis, D. L.; Kafka, S. P.; Chow, J. C.; Nanney, L. B.; Inman, W. H.; McCadden, M. E.; King, L. E., Jr.: Melanoma, growth factors, acanthosis nigricans, the sign of Leser-Trelat, and multiple acrochordons: a possible role for alpha-transforming growth factor in cutaneous paraneoplastic syndromes. New Eng. J. Med. 317: 1582-1587, 1987.

619. Fernandez-Larrea, J.; Merlos-Suarez, A.; Urena, J. M.; Baselga, J.; Arribas, J.: A role for a PDZ protein in the early secretory pathway for the targeting of proTGF-alpha to the cell surface. Molec. Cell 3: 423-433, 1999.

620. Fowler, K. J.; Mann, G. B.; Dunn, A. R.: Linkage of the murine transforming growth factor-alpha gene with Igk, Ly-2, and Fabp1 on chromosome 6. Genomics 16: 782-784, 1993.

621. Tam, J. P.; Scheikh, M. A.; Solomon, D. S.; Ossowski, L.: Efficient synthesis of human type alpha transforming growth factor: its physical and biological characterization. Proc. Nat. Acad. Sci. 83: 8082-8086, 1986.

622. Tricoli, J. V.; Nakai, H.; Byers, M. G.; Rall, L. B.; Bell, G. I.; Shows, T. B.: Assignment of the gene coding for human TGF-alpha to chromosome 2p13. (Abstract) Cytogenet. Cell Genet. 40: 762 only, 1985.

623. Tricoli, J. V.; Nakai, H.; Byers, M. G.; Rall, L. B.; Bell, G. I.; Shows, T. B.: The gene for human transforming growth factor alpha is on the short arm of chromosome 2. Cytogenet. Cell Genet. 42:94-98, 1986.

624. Kikuchi, S.; Hata, M.; Fukumoto, K.; Yamane, Y.; Matsui, T.; Tamura, A.; Yonemura, S.; Yamagishi, H.; Keppler, D.; Tsukita, S.; Tsukita, S.: Radixin deficiency causes conjugated hyperbilirubinemia with loss of Mrp2 from bile canalicular membranes. Nature Genet. 31:320-325, 2002.

625. Wilgenbus, K. K.; Milatovich, A.; Francke, U.; Furthmayr, H.: Molecular cloning, cDNA sequence, and chromosomal assignment of the human radix in gene and two dispersed pseudo genes. Genomics 16: 199-206, 1993.

626. Zahraoui, A.; Touchot, N.; Chardin, P.; Tavitian, A.: The human rab genes encode a family of GTP-binding proteins related to yeast YPT1 and SEC4 products involved in secretion. J. Biol. Chem. 264:12394-12401, 1989.

627. Shimizu, A.; Sakai, Y.; Ohno, K.; Masaki, S.; Kuwano, R.; Takahashi, Y.; Miyashita, N.; Watanabe, T.: A molecular genetic linkage map of mouse chromosome 10, including the Myb, S100b, Pah, SI, and Ifg genes. Biochem. Genet. 30: 529-535, 1992.

628. Tan, M.; Jing, T.; Lan, K.-H.; Neal, C. L.; Li, P.; Lee, S.; Fang, D.; Nagata, Y.; Liu, J.; Arlinghaus, R.; Hung, M.-C.; Yu, D.: Phosphorylation on tyrosine-15 of p34(Cdc2) by ErbB2 inhibits p34(Cdc2) activation and is involved in resistance to taxol-induced apoptosis. Molec. Cell 9: 993-1004, 2002.

629. Spicer, A. P.; Seldin, M. F.; Olsen, A. S.; Brown, N.; Wells, D. E.; Doggett, N. A.; Itano, N.; Kimata, K.; Inazawa, J.; McDonald, J. A.: Chromosomal localization of the human and mouse hyaluronan synthase genes. Genomics 41: 493-497, 1997.

630. Watanabe, K.; Yamaguchi, Y.: Molecular identification of a putative human hyaluronan synthase. J. Biol. Chem. 271: 22945-22948, 1996.

631. Cahill, D. P.; da Costa, L. T.; Carson-Walter, E. B.; Kinzler, K. W.; Vogelstein, B.; Lengauer, C.: Characterization of MAD2B and other mitotic spindle checkpoint genes. Genomics 58: 181-187, 1999.

632. Chen, R.-H.; Waters, J. C.; Salmon, E. D.; Murray, A. W.: Association of spindle assembly checkpoint component XMAD2 with unattached kinetochores. Science 274:242-245, 1996.

633. Dobles, M.; Liberal, V.; Scott, M. L.; Benezra, R.; Sorger, P. K.: Chromosome missegregation and apoptosis in mice lacking the mitotic checkpoint protein Mad2. Cell 101: 635-645, 2000.

634. Krishnan, R.; Goodman, B.; Jin, D.-Y.; Jeang, K.-T.; Collins, C.; Stetten, G.; Spencer, F.: Map location and gene structure of the Homo sapiens mitotic arrest deficient 2 (MAD2L1) gene at 4q27. Genomics 49:475-478, 1998.

635. Li, X.; Nicklas, R. B.: Mitotic forces control a cell-cycle checkpoint. Nature 373:630-632, 1995.

636. Li, Y.; Benezra, R.: Identification of a human mitotic checkpoint gene: hsMAD2. Science 274: 246-248, 1996.

637. Luo, X.; Tang, Z.; Rizo, J.; Yu, H.: The Mad2 spindle checkpoint protein undergoes similar major conformational changes upon binding to either Mad1 or Cdc20. Molec. Cell 9: 59-71, 2002.

638. Michel, L. S.; Liberal, V.; Chatterjee, A.; Kirchwegger, R.; Pasche, B.; Gerald, W.; Dobles, M.; Sorger, P. K.; Murty, V. V. V. S.; Benezra, R.: MAD2 haplo-insufficiency causes premature anaphase and chromosome instability in mammalian cells. Nature 409: 355-359, 2001.

639. Nelson, K. K.; Schlondorff, J.; Blobel, C. P.: Evidence for an interaction of the metalloprotease-disintegrin tumour necrosis factor alpha convertase (TACE) with mitotic arrest deficient 2 (MAD2), and of the metalloprotease-disintegrin MDC9 with a novel MAD2-related protein, MAD2-beta. Biochem. J. 343: 673-680, 1999.

640. Shonn, M. A.; McCarroll, R.; Murray, A. W.: Requirement of the spindle checkpoint for proper chromosome segregation in budding yeast meiosis. Science 289: 300-303, 2000.

641. Xu, L.; Deng, H. X.; Yang, Y.; Xia, J. H.; Hung, W. Y.; Siddque, T.: Assignment of mitotic arrest deficient protein 2 (MAD2L1) to human chromosome band 5q23.3 by in situ hybridization. Cytogenet. Cell Genet. 78: 63-64, 1997.

642. Liu, Y.; Chiu, I.-M.: Assignment of FGF12, the human FGF homologous factor 1 gene, to chromosome 3q29-3qter by fluorescence in situ hybridization. Cytogenet. Cell Genet. 78: 48-49, 1997.

643. Caslini, C.; Spinelli, O.; Cazzaniga, G.; Golay, J.; De Gioia, L.; Pedretti, A.; Breviario, F.; Amaru, R.; Barbui, T.; Biondi, A.; Introna, M.; Rambaldi, A.: Identification of two novel isoforms of the ZNF162 gene: a growing family of signal transduction and activator of RNA proteins. Genomics 42: 268-277, 1997.

644. Kramer, A.; Quentin, M.; Mulhauser, F.: Diverse modes of alternative splicing of human splicing factor SF1 deduced from the exon-intron structure of the gene. Gene 211: 29-37, 1998.

645. Imhof, M. O.; McDonnell, D. P.: Yeast RSP5 and its human homolog hRPF1 potentiate hormone-dependent activation of transcription by human progesterone and glucocorticoid receptors. Molec. Cell. Biol. 16:2594-2605, 1996.

646. Kumar, S.; Harvey, K. F.; Kinoshita, M.; Copeland, N. G.; Noda, M.; Jenkins, N. A.: cDNA cloning, expression analysis, and mapping of the mouse Nedd4 gene. Genomics 40: 435-443, 1997.

647. Bennett, E. P.; Hassan, H.; Clausen, H.: cDNA cloning and expression of a novel human UDPN-acetyl-alpha-D-galactosamine. J. Biol. Chem. 271:17006-17012, 1996.

648. Bennett, E. P.; Weghuis, D. O.; Merkx, G.; Geurts van Kessel, A.; Eiberg, H.; Clausen, H.: Genomic organization and chromosomal localization of three members of the UDP-N-acetylgalactosamine: polypeptide N-acetylgalactosaminyltransferase family. Glycobiology 8: 547-555, 1998.

649. Zara, J.; Hagen, F. K.; Ten Hagen, K. G.; Van Wuyckhuyse, B. C.; Tabak, L. A.: Cloning and expression of mouse UDPGal NAc: polypeptide-N-acetylgalactosaminyltransferase-T3. Biochem. Biophys. Res. Commun. 228: 38-44, 1996.

650. Blake, D. J.; Nawrotzki, R.; Loh, N. Y.; Gorecki, D. C.; Davies, K. E.: Beta-dystrobrevin, a member of the dystrophin-related protein family. Proc. Nat. Acad. Sci. 95: 241-246, 1998.

651. England, S. K.; Uebele, V. N.; Shear, H.; Kodali, J.; Bennett, P. B.; Tamkun, M. M.: Characterization of a voltage-gated K+ channel beta subunit expressed in human heart. Proc. Nat. Acad. Sci. 92:6309-6313, 1995.

652. Jones, J. M.; Bentley, E.; Meisler, M. H.; Darling, S. M.: Genetic mapping of the voltage-gated shaker potassium channel beta subunit Kcnab1 to mouse chromosome 3. Mammalian Genome 9: 260 only, 1998.

653. Leicher, T.; Bahring, R.; Isbrandt, D.; Pongs, O.: Coexpression of the KCNA3B gene product with Kv1.5 leads to a novel A-type potassium channel. J. Biol. Chem. 273: 35095-35101, 1998.

654. Leicher, T. Roeper, J.; Weber, K.; Wang, X.; Pongs, O.: Structural and functional characterization of human potassium channel subunit beta-1 (KCNA1B). Neuropharmacology 35: 787-795, 1996.

655. McCormack, K.; McCormack, T.; Tanouye, M.; Rudy, B.; Stuhmer, W.: Alternative splicing of the human Shaker K+ channel beta-1 gene and functional expression of the beta-2 gene product. FEBS Lett. 370:32-36, 1995.

656. Schultz, D.; Litt, M.; Smith, L.; Thayer, M.; McCormack, K.: Localization of two potassium channel beta subunit genes, KCNA1B and KCNA2B. Genomics 31:389-391, 1996.

657. Kanai, N.; Lu, R.; Satriano, J. A.; Bao, Y.; Wolkoff, A. W.; Schuster, V. L.: Identification and characterization of a prostaglandin transporter. Science 268:866-869, 1995.

658. Lu, R.; Kanai, N.; Bao, Y.; Schuster, V. L.: Cloning, in vitro expression, and tissue distribution of a human prostaglandin transporter cDNA (hPGT). J. Clin. Invest. 98: 1142-1149, 1996.

659. Lu, R.; Schuster, V. L.: Molecular cloning of the gene for the human prostaglandin transporter hPGT: gene organization, promoter activity, and chromosomal localization. Biochem. Biophys. Res. Commun. 246:805-812, 1998.

660. Loughna, S.; Sato, T. N.: A combinatorial role of angiopoietin-1 and orphan receptor TIE1 pathways in establishing vascular polarity during angiogenesis. Molec. Cell 7: 233-239, 2001.

661. Yu, H.; Peters, J.-M.; King, R. W.; Page, A. M.; Hieter, P.; Kirschner, M. W.: Identification of a cull in homology region in a subunit of the anaphase-promoting complex. Science 279: 1219-1222, 1998.

662. Zhao, N.; Lai, F.; Fernald, A. A.; Eisenbart, J. D.; Espinosa, R., III.; Wang, P. W.; Le Beau, M. M.: Human CDC23: cDNA cloning, mapping to 5q31, genomic structure, and evaluation as a candidate tumor suppressor gene in myeloid leukemias. Genomics 53: 184-190, 1998.

663. Brambilla, R.; Draetta, G.: Molecular cloning of PISSLRE, a novel putative member of the cdk family of protein serine/threonine kinases. Oncogene 9:3037-3041, 1994.

664. Grana, X.; Claudio, P. P.; De Luca, A.; Sang, N.; Giordano, A.: PISSLRE, a human novel CDC2-related protein kinase. Oncogene 9:2097-2103, 1994.

665. Deak, M.; Clifton, A. D.; Lucocq, J. M.; Alessi, D. R.: Mitogen- and stress-activated protein kinase-1 (MSK1) is directly activated by MAPK and SAPK2/p38, and may mediate activation of CREB. EMBO J. 17:4426-4441, 1998.

666. Jiang, C.; Yu, L.; Tu, Q.; Zhao, Y.; Zhang, H.; Zhao, S.: Assignment of a member of the ribosomal protein S6 kinase family, RPS6KA5, to human chromosome 14q31-q32.1 by radiation hybrid mapping. Cytogenet. Cell Genet. 87: 261-261, 1999.

667. Marsters, S. A.; Sheridan, J. P.; Pitti, R. M.; Huang, A.; Skubatch, M.; Baldwin, D.; Yuan, J.; Gurney, A.; Goddard, A. D.; Godowski, P.; Ashkenazi, A.: A novel receptor for Apo2L/TRAIL contains a truncated death domain. Curr. Biol. 7: 1003-1006, 1997.

668. MacFarlane, M.; Ahmad, M.; Srinivasula, S. M.; Fernandes-Alnemri, T.; Cohen, G. M.; Alnemri, E. S.: Identification and molecular cloning of two novel receptors for the cytotoxic ligand TRAIL. J. Biol. Chem. 272:25417-25420, 1997.

669. Pai, S. I.; Wu, G. S.; Ozoren, N.; Wu, L.; Jen, J.; Sidransky, D.; El-Deiry, W. S.: Rare loss-of-function mutation of a death receptor gene in head and neck cancer. Cancer Res. 58: 3513-3518, 1998.

670. Pan, G.; Ni, J.; Wei, Y.-F.; Yu, G.; Gentz, R.; Dixit, V. M.: An antagonist decoy receptor and a death domain-containing receptor for TRAIL. Science 277: 815-818, 1997.

671. Schneider, P.; Bodmer, J.-L.; Thome, M.; Hofmann, K.; Holler, N.; Tschopp, J.: Characterization of two receptors for TRAIL. FEBS Lett. 416:329-334, 1997.

672. Screaton, G. R.; Mongkolsapaya, J.; Xu, X.-N.; Cowper, A. E.; McMichael, A. J.; Bell, J. I.: TRICK2, a new alternatively spliced receptor that transduces the cytotoxic signal from TRAIL. Curr. Biol. 7:693-696, 1997.

673. Sheridan, J. P.; Marsters, S. A.; Pitti, R. M.; Gurney, A.; Skubatch, M.; Baldwin, D.; Ramakrishnan, L.; Gray, C. L.; Baker, K.; Wood, W. I.; Goddard, A. D.; Godowski, P.; Ashkenazi, A.: Control of TRAIL-induced apoptosis by a family of signaling and decoy receptors. Science 277:818-821, 1997.

674. Nakamura, T.; Takeuchi, K.; Muraoka, S.; Takezoe, H.; Takahashi, N.; Mori, N.: A neurally enriched coronin-like protein, ClipinC, is a novel candidate for an actin cytoskeleton-cortical membrane-linking protein. J. Biol. Chem. 274: 13322-13327, 1999.

675. Abbaszade, I.; Liu, R.-Q.; Yang, F.; Rosenfeld, S. A.; Ross, O. H.; Link, J. R.; Ellis, D. M.; Tortorella, M. D.; Pratta, M. A.; Hollis, J. M.; Wynn, R.; Duke, J. L.; and 15 others: Cloning and characterization of ADAMTS11, an aggrecanase from the ADAMTS family. J. Biol. Chem. 274:23443-23450, 1999.

676. Hagiwara, T.; Tanaka, K.; Takai, S.; Maeno-Hikichi, Y.; Mukainaka, Y.; Wada, K.: Genomic organization, promoter analysis, and chromosomal localization of the gene for the mouse glial high-affinity glutamate transporter Slc1a3. Genomics 33: 508-515, 1996.

677. Harada, T.; Harada, C.; Watanabe, M.; Inoue, Y.; Sakagawa, T.; Nakayama, N.; Sasaki, S.; Okuyama, S.; Watase, K.; Wada, K.; Tanaka, K.: Functions of the two glutamate transporters GLAST and GLT-1 in the retina. Proc. Nat. Acad. Sci. 95: 4663-4666, 1998.

678. Keppen, L. D.; Gollin, S. M.; Edwards, D.; Sawyer, J.; Wilson, W.; Overhauser, J.: Clinical phenotype and molecular analysis of a three-generation family with an interstitial deletion of the short arm of chromosome 5. Am. J. Med. Genet. 44: 356-360, 1992.

679. Kirschner, M. A.; Arriza, J. L.; Copeland, N. G.; Gilbert, D. J.; Jenkins, N. A.; Magenis, E.; Amara, S. G.: The mouse and human excitatory amino acid transporter gene (EAAT1) maps to mouse chromosome 15 and a region of syntenic homology on human chromosome 5. Genomics 22:631-633, 1994.

680. Shashidharan, P.; Huntley, G. W.; Meyer, T.; Morrison, J. H.; Plaitakis, A.: Neuron-specific human glutamate transporter: molecular cloning, characterization and expression in human brain. Brain Res. 662:245-250, 1994.

681. Stoffel, W.; Sasse, J.; Duker, M.; Muller, R.; Hofmann, K.; Fink, T.; Lichter, P.: Human high affinity, Na(+)-dependent L-glutamate/L-aspartate transporter GLAST-1 (EAAT-1): gene structure and localization to chromosome 5p11-p12. FEBS Lett. 386: 189-193, 1996.

682. Takai, S.; Yamada, K.; Kawakami, H.; Tanaka, K.; Nakamura, S.: Localization of the gene (SLC1A3) encoding human glutamate transporter (GluT-1) to 5p13 by fluorescence in situ hybridization. Cytogenet. Cell Genet. 69: 209-210, 1995.

683. LeClair, K. P.; Rabin, M.; Nesbitt, M. N.; Pravtcheva, D.; Ruddle, F. H.; Palfree, R. G. E.; Bothwell, A.: Murine Ly-6 multigene family is located on chromosome 15. Proc. Nat. Acad. Sci. 84: 1638-1642, 1987.

684. Fischer, A.; Durandy, A.; Sterkers, G.; Griscelli, C.: Role of the LFA-1 molecule in cellular interactions required for antibody production in humans. J. Immun. 136: 3198-3203, 1986.

685. Marlin, S. D.; Morton, C. C.; Anderson, D. C.; Springer, T. A.: LFA-1 immunodeficiency disease: definition of the genetic defect and chromosomal mapping of alpha and beta subunits of the lymphocyte function-associated antigen 1 (LFA-1) by complementation in hybrid cells. J. Exp. Med. 164: 855-867, 1986.

686. Blackwood, E.; Eisenman, R. N.: Max: a helix-loop-helix zipper protein that forms a sequence-specific DNA-binding complex with Myc. Science 251:1211-1217, 1991.

687. Eisenman, R. N.: Personal Communication. Seattle, Wash. Jul. 27, 1994.

688. Gilladoga, A. D.; Edelhoff, S.; Blackwood, E. M.; Eisenman, R. N.; Disteche, C. M.: Mapping of MAX to human chromosome 14 and mouse chromosome 12 by in situ hybridization. Oncogene 7: 1249-1251, 1992.

689. Bulavin, D. V.; Higashimoto, Y.; Popoff, I. J.; Gaarde, W. A.; Basrur, V.; Potapova, O.; Appella, E.; Formace, A. J., Jr.: Initiation of a G2/M checkpoint after ultraviolet radiation requires p38 kinase. Nature 411:102-107, 2001.

690. Doonan, S.; Barra, D.; Bossa, F.: Structural and genetic relationships between cytosolic and mitochondrial isoenzymes. Int. J. Biochem. 16:1193-1199, 1984.

691. Copeland, N. G.; Silan, C. M.; Kingsley, D. M.; Jenkins, N. A.; Cannizzaro, L. A.; Croce, C. M.; Huebner, K.; Sims, J. E.: Chromosomal location of murine and human IL-1 receptor genes. Genomics 9: 44-50, 1991.

692. Dale, M.; Nicklin, M. J.: Interleukin-1 receptor cluster: gene organization of IL1R2, IL1R1, IL1RL2 (IL-1Rrp2), IL1RL1 (T1/ST2), and IL18R1 (IL-1Rrp) on human chromosome 2q. Genomics 57: 177-179, 1999.

693. Dower, S. K.; Kronheim, S. R.; Hopp, T. P.; Cantrell, M.; Deeley, M.; Gillis, S.; Henney, C. S.; Urdal, D. L.: The cell surface receptors for interleukin-1(alpha) and interleukin-1(beta) are identical. Nature 324:266-268, 1986.

694. Sims, J. E.; Acres, R. B.; Grubin, C. E.; McMahan, C. J.; Wignall, J. M.; March, C. J.; Dower, S. K.: Cloning the interleukin 1 receptor from human T cells. Proc. Nat. Acad. Sci. 86: 8946-8950, 1989.

695. Justice, M. J.; Siracusa, L. D.; Gilbert, D. J.; Heisterkamp, N.; Groffen, J.; Chada, K.; Silan, C. M.; Copeland, N. G.; Jenkins, N. A.: A genetic linkage map of mouse chromosome 10: localization of eighteen molecular markers using a single interspecific backcross. Genetics 125: 855-866, 1990.

696. Smith, E. P.; Boyd, J.; Frank, G. R.; Takahashi, H.; Cohen, R. M.; Specker, B.; Williams, T. C.; Lubahn, D. B.; Korach, K. S.: Estrogen resistance caused by a mutation in the estrogen-receptor gene in a man. New Eng. J. Med. 331: 1056-1061, 1994.

697. Costa, R. M.; Federov, N. B.; Kogan, J. H.; Murphy, G. G.; Stern, J.; Ohno, M.; Kucherlapati, R.; Jacks, T.; Silva, A. J.: Mechanism for the learning deficits in a mouse model of neurofibromatosis type 1. Nature 415: 526-530, 2002.

698. van de Vijver, M. J.; Peterse, J. L.; Mooi, W. J.; Wisman, P.; Lomans, J.; Dalesio, O.; Nusse, R.: NEU-protein overexpression in breast cancer: association with come do-type ductal carcinoma in situ and limited prognostic value in stage II breast cancer. New Eng. J. Med. 319: 1239-1245, 1988.

699. Xie, D.; Shu, X. O.; Deng, Z.; Wen, W.-Q.; Creek, K. E.; Dai, Q., Gao, Y.-T.; Jin, F.; Zheng, W.: Population-based, case-control study of HER2 genetic polymorphism and breast cancer risk. J. Nat. Cancer Inst. 92: 412-417, 2000.

700. Yamamoto, T.; Ikawa, S.; Akiyama, T.; Semba, K.; Nomura, N.; Miyajima, N.; Saito, T.; Toyoshima, K.: Similarity of protein encoded by the human c-erb-B-2 gene to epidermal growth factor receptor. Nature 319:230-234, 1986.

701. Yang-Feng, T. L.; Schechter, A. L.; Weinberg, R. A.; Francke, U.: Oncogene from rat neuro/glioblastomas (human gene symbol NGL) is located on the proximal long arm of human chromosome 17 and EGFR is confirmed at 7p13-q11.2. (Abstract) Cytogenet. Cell Genet. 40:784 only, 1985.

702. Yu, D.; Jing, T.; Liu, B.; Yao, J.; Tan, M.; McDonnell, T. J.; Hung, M.-C.: Overexpression of ErbB2 blocks Taxol-induced apoptosis by upregulation of p21Cip1, which inhibits p34Cdc2 kinase. Molec. Cell 2: 581-591, 1998.

703. Fukuhara, S.; Rowley, J. D.; Variakojis, D.; Sweet, D. L.: Chromosome abnormalities in poorly differentiated lymphocytic lymphoma. Cancer Res. 39: 3119-3128, 1979.

704. Ohno, H.; Fukuhara, S.; Takahashi, R.; Mihara, K.; Sugiyama, T.; Doi, S.; Uchino, H.; Toyoshima, K.: c-yes and bcl-2 genes located on 18q21.3 in a follicular lymphoma cell line carrying a t(14;18) chromosomal translocation. Int. J. Cancer 39: 785-788, 1987.

705. Semba, K.; Nishizawa, M.; Satoh, H.; Fukushige, S.; Yoshida, M. C.; Sasaki, M.; Matsubara, K.; Yamamoto, T.; Toyoshima, K.: Nucleotide sequence and chromosomal mapping of the human c-yes-2 gene. Jpn. J. Cancer Res. 79: 710-717, 1988.

706. Semba, K.; Yamanashi, Y.; Nishizawa, M.; Sukegawa, J.; Yoshida, M.; Sasaki, M.; Yamamoto, T.; Toyoshima, K.: Location of the c-yes gene on the human chromosome and its expression in various tissues. Science 227:1038-1040, 1985.

707. Silverman, G. A.; Kuo, W.-L.; Taillon-Miller, P.; Gray, J. W.: Chromosomal reassignment: YACs containing both YES1 and thymidylate synthase map to the short arm of chromosome 18. Genomics 15: 442-445, 1993.

708. Sukegawa, J.; Semba, K.; Yamanashi, Y.; Nishizawa, M.; Miyajima, N.; Yamamoto, T.; Toyoshima, K.: Characterization of cDNA clones for the human c-yes gene. Molec. Cell. Biol. 7: 41-47, 1987.

709. de Wit, T. P. M.; Morton, H. C.; Capel, P. J. A.; van de Winkel, J. G. J.: Structure of the gene for the human myeloid IgA Fc receptor (CD89). J. Immun. 155: 1203-1209, 1995.

710. Kremer, E. J.; Kalatzis, V.; Baker, E.; Callen, D. F.; Sutherland, G. R.; Maliszewski, C. R.: The gene for the human IgA Fc receptor maps to 19q13.4. Hum. Genet. 89: 107-108, 1992.

711. Maliszewski, C. R.; March, C. J.; Schoenborn, M. A.; Gimpel, S.; Shen, L.: Expression cloning of a human Fc receptor for IgA. J. Exp. Med. 172: 1665-1672, 1990.

712. Monteiro, R. C.; Hostoffer, R. W.; Cooper, M. D.; Bonner, J. R.; Gartland, G. L.; Kubagawa, H.: Definition of immunoglobulin A receptors on eosinophils and their enhanced expression in allergic individuals. J. Clin. Invest. 92: 1681-1685, 1993.

713. Narita, I.; Goto, S.; Saito, N.; Sakatsume, M.; Jin, S.; Omori, K.; Gejyo, F.: Genetic polymorphisms in the promoter and 5-prime UTR region of the Fc alpha receptor (CD89) are not associated with a risk of IgA nephropathy. J. Hum. Genet. 46: 694-698, 2001.

714. Pleass, R. J.; Andrews, P. D.; Kerr, M. A.; Woof, J. M.: Alternative splicing of the human IgA Fc receptor CD89 in neutrophils and eosinophils. Biochem. J. 318: 771-777, 1996.

715. Shimokawa, T.; Tsuge, T.; Okumura, K.; Ra, C.: Identification and characterization of the promoter for the gene encoding the human myeloid IgA Fc receptor (Fc-alpha-R, CD89). Immunogenetics 51: 945-954, 2000.

716. Tsuge, T.; Shimokawa, T.; Horikoshi, S.; Tomino, Y.; Ra, C.: Polymorphism in promoter region of Fc-alpha receptor gene in patients with IgA nephropathy. Hum. Genet. 108: 128-133, 2001.

717. Dillon, J. S.; Tanizawa, Y.; Wheeler, M. B.; Leng, X.-H.; Ligon, B. B.; Rabin, D. U.; Yoo-Warren, H.; Permutt, M. A.; Boyd, A. E., III: Cloning and functional expression of the human glucagon-like peptide-1 (GLP-1) receptor. Endocrinology 133: 1907-1910, 1993.

718. Kershaw, E. E.; Chua, S. C., Jr.; Leibel, R. L.: Localization of a (CA)n repeat in glucagon-like peptide-1 receptor gene (Glp1r) to proximal mouse chromosome 17 and its linkage to other markers. Mammalian Genome 6: 301-303, 1995.

719. Stoffel, M.; Espinosa, R., III; Le Beau, M. M.; Bell, G. I.: Human glucagon-like peptide-1 receptor gene: localization to chromosome band 6p21 by fluorescence in situ hybridization and linkage of a highly polymorphic simple tandem repeat DNA polymorphism to other markers on chromosome 6. Diabetes 42: 1215-1218, 1993.

720. Thorens, B.: Expression cloning of the pancreatic beta cell receptor for the gluco-incretin hormone glucagon-like peptide 1. Proc. Nat. Acad. Sci. 89: 8641-8645, 1992.

721. Cohen, P.; Miyazaki, M.; Socci, N. D.; Hagge-Greenberg, A. Liedtke, W.; Soukas, A. A.; Sharma, R.; Hudgins, L. C.; Ntambi, J. M.; Friedman, J. M.: Role for stearoyl-CoA desaturase-1 in leptin-mediated weightloss. Science 297: 240-243, 2002.

722. Blangy, A.; Lane, H. A.; d'Herin, P.; Harper, M.; Kress, M.; Nigg, E. A.: Phosphorylation by p34(cdc2) regulates spindle association of human Eg5, a kinesin-related motor essential for bipolar spindle formation in vivo. Cell 83: 1159-1169, 1995.

723. Stewart, R. J.; Pesavento, P. A.; Woerpel, D. N.; Goldstein, L. S. B.: Identification and partial characterization of six members of the kinesin superfamily in *Drosophila*. Proc. Nat. Acad. Sci. 88:8470-8474, 1991.

724. Tihy, F.; Kress, M.; Harper, M.; Dutrillaux, B.; Lemieux, N.: Localization of the human kinesin-related gene to band 10q24 by fluorescencein situ hybridization. Genomics 13: 1371-1372, 1992.

725. Tassabehji, M.; Newton, V. E.; Liu, X.-Z.; Brady, A.; Donnai, D.; Krajewska-Walasek, M.; Murday, V.; Norman, A.; Obersztyn, E.; Reardon, W.; Rice, J. C.; Trembath, R.; Wieacker, P.; Whiteford, M.; Winter, R.; Read, A. P.: The mutational spectrum in Waardenburg syndrome. Hum. Molec. Genet. 4: 2131-2137, 1995.

726. Cetta, F.; Chiappetta, G.; Melillo, R. M.; Petracci, M.; Montalto, G.; Santoro, M.; Fusco, A.: The ret/ptc1 oncogene is activated in familial adenomatous polyposis-associated thyroid papillary carcinomas. J. Clin. Endocr. Metab. 83: 1003-1006, 1998.

727. Decker, R. A.; Peacock, M. L.; Watson, P.: Hirschsprung disease in MEN 2A: increased spectrum of RET exon 10 genotypes and strong genotype-phenotype correlation. Hum. Molec. Genet. 7: 129-134, 1998.

728. Donis-Keller, H.; Dou, S.; Chi, D.; Carlson, K. M.; Toshima, K.; Lairmore, T. C.; Howe, J. R.; Moley, J. F.; Goodfellow, P.; Wells, S. A., Jr.: Mutations in the RET proto-oncogene are associated with MEN 2A and FMTC. Hum. Molec. Genet. 2: 851-856, 1993.

729. Doray, B.; Salomon, R.; Amiel, J.; Pelet, A.; Touraine, R.; Billaud, M.; Attie, T.; Bachy, B.; Munnich, A.; Lyonnet, S.: Mutation of the RET ligand, neurturin, supports multigenic inheritance in Hirschsprung disease. Hum. Molec. Genet. 7: 1449-1452, 1998.

730. Edery, P.; Lyonnet, S.; Mulligan, L. M.; Pelet, A.; Dow, E.; Abel, L.; Holder, S.; Nihoul-Fekete, C.; Ponder, B. A. J.; Munnich, A.: Mutations of the RET proto-oncogene in Hirschsprung's disease. Nature 367:378-380, 1994.

731. Eng, C.: The RET proto-oncogene in multiple endocrine neoplasia type 2 and Hirschsprung's disease. New Eng. J. Med. 335: 943-951, 1996.

732. Eng, C.; Crossey, P. A.; Mulligan, L. M.; Healey, C. S.; Houghton, C.; Prowse, A.; Chew, S. L.; Dahia, P. L. M.; O'Riordan, J. L. H.; Toledo, S. P. A.; Smith, D. P.; Maher, E. R.; Ponder, B. A. J.: Mutations in the RET proto-oncogene and the von Hippel-Lindau disease tumour suppressor gene in sporadic and syndromic phaeochromocytomas. J. Clin. Genet. 32: 934-937, 1995.

733. Eng, C.; Mulligan, L. M.: Mutations of the RET proto-oncogenein the multiple endocrine neoplasia type 2 syndromes, related sporadic tumours, and Hirschsprung disease. Hum. Mutat. 9: 97-109, 1997.

734. Eng, C.; Mulligan, L. M.; Smith, D. P.; Healey, C. S.; Frilling, A.; Raue, F.; Neumann, H. P. H.; Pfragner, R.; Behmel, A.; Lorenzo, M. J.; Stonehouse, T. J.; Ponder, M. A.; Ponder, B. A. J.: Mutation of the RET protooncogene in sporadic medullary thyroid carcinoma. Genes Chromosomes Cancer 12: 209-212, 1995.

735. Eng, C.; Smith, D. P.; Mulligan, L. M.; Healey, C. S.; Zvelebil, M. J.; Stonehouse, T. J.; Ponder, M. A.; Jackson, C. E.; Waterfield, M. D.; Ponder, B. A. J.: A novel point mutation in the tyrosine kinase domain of the RET proto-oncogene in sporadic medullary thyroid carcinoma and in a family with FMTC. Oncogene 10: 509-513, 1995.

736. Eng, C.; Smith, D. P.; Mulligan, L. M.; Nagai, M. A.; Healey, C. S.; Ponder, M. A.; Gardner, E.; Scheumann, G. F. W.; Jackson, C. E.; Tunnacliffe, A.; Ponder, B. A. J.: Point mutation within the tyrosine kinase domain of the RET proto-oncogene in multiple endocrine neoplasia type 2B and related sporadic tumors. Hum. Molec. Genet. 3:237-241, 1994.

737. Fearon, E. R.: Human cancer syndromes: clues to the origin and nature of cancer. Science 278: 1043-1050, 1997.

738. Fitze, G.; Schreiber, M.; Kuhlisch, E.; Schackert, H. K.; Roesner, D.: Association of RET protooncogene codon 45 polymorphism with Hirschsprung disease. (Letter) Am. J. Hum. Genet. 65: 1469-1473, 1999.

739. Gardner, E.; Mulligan, L. M.; Eng, C.; Healey, C. S.; Kwok, J. B. J.; Ponder, M. A.; Ponder, B. A. J.: Haplotype analysis of MEN2 mutations. Hum. Molec. Genet. 3: 1771-1774, 1994.

740. Grieco, M.; Santoro, M.; Berlingieri, M. T.; Melillo, R. M.; Donghi, R.; Bongarzone, I.; Pierotti, M. A.; Della Porta, G.; Fusco, A.; Vecchio, G.: PTC is a novel rearranged form of the ret proto-oncogene and is frequently detected in vivo in human thyroid papillary carcinomas. Cell 60:557-563, 1990.

741. Hofstra, R. M. W.; Landsvater, R. M.; Ceccherini, I.; Stulp, R. P.; Stelwagen, T.; Luo, Y.; Pasini, B.; Hoppener, J. W. M.; Ploosvan Amstel, H. K.; Romeo, G.; Lips, C. J. M.; Buys, C. H. C. M.: A mutation in the RET proto-oncogene associated with multiple endocrine neoplasia type 2B and sporadic medullary thyroid carcinoma. Nature 367:375-376, 1994.

742. Hoppener, J. W. M.; Lips, C. J. M.: RET receptor tyrosine kinase gene mutations: molecular biological, physiological and clinical aspects. Europ. J. Clin. Invest. 26: 613-624, 1996.

743. Hoppner, W.; Ritter, M. M.: A duplication of 12 bp in the critical cysteine rich domain of the RET proto-oncogene results in a distinct phenotype of multiple endocrine neoplasia type 2A. Hum. Molec. Genet. 6:587-590, 1997.

744. Ikeda, I.; Ishizaka, Y.; Tahira, T.; Suzuki, T.; Onda, M.; Sugimura, T.; Nagao, M.: Specific expression of the ret proto-oncogene in human neuroblastoma cell lines. Oncogene 5: 1291-1296, 1990.

745. Ishizaka, Y.; Itoh, F.; Tahira, T.; Ikeda, I.; Sugimura, T.; Tucker, J.; Fertitta, A.; Carrano, A. V.; Nagao, M.: Human ret proto-oncogene mapped to chromosome 10q11.2. Oncogene 4: 1519-1521, 1989.

746. Japon, M. A.; Urbano, A. G.; Saez, C.; Segura, D. I.; Cerro, A. L.; Dieguez, C.; Alvarez, C. V.: Glial-derived neurotropic factor and RET gene expression in normal human anterior pituitary cell types and in pituitary tumors. J. Clin. Endocr. Metab. 87: 1879-1884, 2002.

747. Julies, M. G.; Moore, S. W.; Kotze, M. J.; du Plessis, L.: Novel RET mutations in Hirschsprung's disease patients from the diverse South African population. Europ. J. Hum. Genet. 9: 419-423, 2001.

748. Klugbauer, S.; Demidchik, E. P.; Lengfelder, E.; Rabes, H. M.: Detection of a novel type of RET rearrangement (PTC5) in thyroid carcinomas after Chernobyl and analysis of the involved RET-fused gene RFG5. Cancer Res. 58: 198-203, 1998.

749. Amagai, M.; Nishikawa, T.; Nousari, H. C.; Anhalt, G. J.; Hashimoto, T.: Antibodies against desmoglein 3 (pemphigus vulgaris antigen) are present in sera from patients with paraneoplastic pemphigus and cause acantholysis in vivo in neonatal mice. J. Clin. Invest. 102:775-782, 1998.

750. Arnemann, J.; Spurr, N. K.; Buxton, R. S.: The human gene (DSG3) coding for the pemphigus vulgaris antigen is, like the genes coding for the other two known desmogleins, assigned to chromosome 18. Hum. Genet. 89: 347-350, 1992.

751. Ishikawa, H.; Silos, S. A.; Tamai, K.; Copeland, N. G.; Gilbert, D. J.; Jenkins, N. A.; Uitto, J.: cDNA cloning and chromosomal assignment of the mouse gene for desmoglein 3 (Dsg3), the pemphigus vulgaris antigen. Mammalian Genome 5: 803-804, 1994.

752. Silos, S. A.; Tamai, K.; Li, K.; Kivirikko, S.; Kouba, D.; Christiano, A. M.; Uitto, J.: Cloning of the gene for human pemphigus vulgaris antigen (desmoglein 3), a desmosomal cadherin. J. Biol. Chem. 271:17504-17511, 1996.

753. Hamajima, N.; Matsuda, K.; Sakata, S.; Tamaki, N.; Sasaki, M.; Nonaka, M.: A novel gene family defined by human dihydropyrimidinase and three related proteins with differential tissue distribution. Gene 180:157-163, 1996.

754. Sharp, D.; Blinderman, L.; Combs, K. A.; Kienzle, B.; Ricci, B.; Wager-Smith, K.; Gil, C. M.; Turck, C. W.; Bouma, M.-E.; Rader, D. J.; Aggerbeck, L. P.; Gregg, R. E.; Gordon, D. A.; Wetterau, J. R.: Cloning and gene defects in microsomal triglyceride transfer protein associated with abetalipoproteinaemia. Nature 365: 65-69, 1993.

755. Julier, C.; Lathrop, M.; Lalouel, J. M.; Kaplan, J. C.: Use of multilocus tests of gene order: example for chromosome 22. (Abstract) Cytogenet. Cell Genet. 40: 663-664, 1985.

756. Julier, C.; Lathrop, M.; Lalouel, J. M.; Reghis, A.; Szajnert, M. F.; Kaplan, J. C.: New restriction fragment length polymorphisms on human chromosome 22 at loci SIS, MB and IGLV. (Abstract) Cytogenet. Cell Genet. 40: 664 only, 1985.

757. Julier, C.; Reghis, A.; Szajnert, M. F.; Kaplan, J. C.; Lathrop, G. M.; Lalouel, J. M.: A preliminary linkage map of human chromosome 22. (Abstract) Cytogenet. Cell Genet. 40: 665 only, 1985.

758. Bodmer, J. G.; Marsh, S. G. E.; Albert, E.: Nomenclature for factors of the HLA system, 1989. Immun. Today 11: 3-10, 1990.

759. Fitzgerald, L. A.; Poncz, M.; Steiner, B.; Rall, S. C., Jr.; Bennett, J. S.; Phillips, D. R.: Comparison of cDNA-derived protein sequences of the human fibronectin and vitronectin receptor alpha-subunits and platelet glycoprotein IIb. Biochemistry 26: 8158-8165, 1987.

760. Sosnoski, D.; Emanuel, B. S.; Hawkins, A. L.; van Tuinen, P.; Ledbetter, D. H.; Nussbaum, R. L.; Kaos, F.-T.; Schwartz, E.; Phillips, D.; Bennett, J. S.; Fitzgerald, L. A.; Poncz, M.: Chromosomal localization of the genes for the vitronectin and fibronectin receptors alpha-subunits and for platelet glycoproteins IIb and IIIa. J. Clin. Invest. 81:1993-1998, 1988.

761. Spurr, N. K.; Rooke, L.: Confirmation of the assignment of the vitronectin (VNRA) and fibronectin (FNRA) receptor alpha-subunits. Ann. Hum. Genet. 55: 217-223, 1991.

762. Akula, S. M.; Pramod, N. P.; Wang, F.-Z.; Chandran, B.: Integrin alpha-3/beta-1 (CD 49c/29) is a cellular receptor for Kaposi's sarcoma-associated herpesvirus (KSHV/HHV-8) entry into the target cells. Cell 108:407-419, 2002.

763. Arregui, C.; Pathre, P.; Lilien, J.; Balsamo, J.: The non-receptor tyrosine kinase Fer mediates cross-talk between N-cadherin and beta-1-integrins. J. Cell Biol. 149: 1263-1273, 2000.

764. Giuffra, L. A.; Lichter, P.; Wu, J.; Kennedy, J. L.; Pakstis, A. J.; Rogers, J.; Kidd, J. R.; Harley, H.; Jenkins, T.; Ward, D. C.; Kidd, K. K.: Genetic and physical mapping and population studies of a fibronectin receptor beta-subunit-like sequence on human chromosome 19. Genomics 8: 340-346, 1990.

765. Giuffra, L. A.; Wu, J.; Lichter, P.; Kennedy, J. L.; Castiglione, C.; Pakstis, A. J.; Ward, D.; Kidd, K. K.: Mapping of a fibronectin receptor beta subunit-like sequence to chromosome 19. (Abstract) Am. J. Hum. Genet. 45 (suppl.): A141 only, 1989.

766. Goodfellow, P. J.; Nevanlinna, H. A.; Gorman, P.; Sheer, D.; Lam, G.; Goodfellow, P. N.: Assignment of the gene encoding the beta-subunit of the human fibronectin receptor (beta-FNR) to chromosome 10p11.2. Ann. Hum. Genet. 53: 15-22, 1989.

767. Graus-Porta, D.; Blaess, S.; Senften, M.; Littlewood-Evans, A.; Damsky, C.; Huang, Z.; Orban, P.; Klein, R.; Schittny, J. C.; Muller, U.: Beta-1-class integrins regulate the development of laminae and folia in the cerebral and cerebellar cortex. Neuron 31: 367-379, 2001.

768. Hynes, R. O.: Integrins: a family of cell surface receptors. Cell 48:549-554, 1987.

769. Johansson, S.; Forsberg, E.; Lundgren, B.: Comparison of fibronectin receptors from rat hepatocytes and fibroblasts. J. Biol. Chem. 262:7819-7824, 1987.

770. Lu, T. T.; Cyster, J. G.: Integrin-mediated long-term B cell retention in the splenic marginal zone. Science 297: 409-412, 2002.

771. Messer Peters, P.; Kamarck, M. E.; Hemler, M. E.; Strominger, J. L.; Ruddle, F. H.: Genetic and biochemical characterization of human lymphocyte cell surface antigens: the A-1A5 and A-3A4 determinants. J. Exp. Med. 159: 1441-1454, 1984.

772. Pytela, R.; Pierschbacher, M. D.; Ginsberg, M. H.; Plow, E. F.; Ruoslahti, E.: Platelet membrane glycoprotein IIb/IIIa: member of a family of arg-gly-asp-specific adhesion receptors. Science 231:1159-1162, 1986.

773. Woods, V. L., Jr.; Pischel, K. D.; Avery, E. D.; Bluestein, H. G.: Antigenic polymorphism of human very late activation protein-2(platelet glycoprotein Ia-IIa): platelet alloantigen Hc(a). J. Clin. Invest. 83: 978-985, 1989.

774. Wu, J. S.; Giuffra, L. A.; Goodfellow, P. J.; Myers, S.; Carson, N. L.; Anderson, L.; Hoyle, L. S.; Simpson, N. E.; Kidd, K. K.: Thebeta subunit locus of the human fibronectin receptor: DNA restriction fragment length polymorphism and linkage mapping studies. Hum. Genet. 83:383-390, 1989.

775. Wildhage, I.; Trusheim, H.; Goke, B.; Lankat-Buttgereit, B.: Gene expression of the human glucagon-like peptide-1 receptor is regulated by Sp1 and Sp3. Endocrinology 140: 624-631, 1999.

776. Chambers, S. M.; Morris, B. J.: Glucagon receptor gene mutation in essential hypertension. (Letter) Nature Genet. 12: 122, 1996.

777. Hager, J.; Hansen, L.; Vaisse, C.; Vionnet, N.; Philippi, A.; Poller, W.; Velho, G.; Carcassi, C.; Contu, L.; Julier, C.; Cambien, F.; Passa, P.; Lathrop, M.; Kindsvogel, W.; Demenais, F.; Nishimura, E.; Froguel, P.: A missense mutation in the glucagon receptor gene is associated with non-insulin-dependent diabetes mellitus. Nature Genet. 9: 299-304, 1995.

778. Lok, S.; Kuijper, J. L.; Jelinek, L. J.; Kramer, J. M.; Whitmore, T. E.; Sprecher, C. A.; Mathewes, S.; Grant, F. J.; Biggs, S. H.; Rosenberg, G. B.; Sheppard, P. O.; O'Hara, P. J.; Foster, D. C.; Kindsvogel, W.: The human glucagon receptor encoding gene: structure, cDNA sequence and chromosomal localization. Gene 140: 203-209, 1994.

779. Menzel, S.; Stoffel, M.; Espinosa, R., III; Fernald, A. A.; LeBeau, M. M.; Bell, G. I.: Localization of the glucagon receptor gene to human chromosome band 17q25. Genomics 20: 327-328, 1994.

780. Bae, J.; Leo, C. P.; Hsu, S. Y.; Hsuch, A. J. W.: MCL-1S, a splicing variant of the antiapoptotic BCL-2 family member MCL-1, encodes aproapoptotic protein possessing only the BH3 domain. J. Biol. Chem. 275:25255-25261, 2000.

781. Craig, R. W.; Jabs, E. W.; Zhou, P.; Kozopas, K. M.; Hawkins, A. L.; Rochelle, J. M.; Seldin, M. F.; Griffin, C. A.: Human and mouse chromosomal mapping of the myeloid cell leukemia-1 gene: MCL1 maps to human chromosome 1q21, a region that is frequently altered in preneoplastic and neoplastic disease. Genomics 23: 457-463, 1994.

782. Kozopas, K. M.; Yang, T.; Buchan, H. L.; Zhou, P.; Craig, R. W.: MCL1, a gene expressed in programmed myeloid cell differentiation, has sequence similarity to BCL2. Proc. Nat. Acad. Sci. 90: 3516-3520, 1993.

783. Rinkenberger, J. L.; Horning, S.; Klocke, B.; Roth, K.; Korsmeyer, S. J.: Mcl-1 deficiency results in peri-implantation embryonic lethality. Genes Dev. 14: 23-27, 2000.

784. Pellegata, N. S.; Dieguez-Lucena, J. L.; Joensuu, T.; Lau, S.; Montgomery, K. T.; Krahe, R.; Kivela, T.; Kucherlapati, R.; Forsius, H.; de la Chapelle, A.: Mutations in KERA, encoding keratocan, causecornea plana. Nature Genet. 25: 91-95, 2000.

785. Lehmann, J. M.; McKee, D. D.; Watson, M. A.; Willson, T. M.; Moore, J. T.; Kliewer, S. A.: The human orphan nuclear receptor PXR is activated by compounds that regulate CYP3A4 gene expression and cause drug interactions. J. Clin. Invest. 102: 1016-1023, 1998.

786. Aberdam, E.; Bertolotto, C.; Sviderskaya, E. V.; de Thillot, V.; Hemesath, T. J.; Fisher, D. E.; Bennett, D. C.; Ortonne, J.-P.; Ballotti, R.: Involvement of microphthalmia in the inhibition of melanocyte lineage differentiation and of melanogenesis by agouti signal protein. J. Biol. Chem. 273: 19560-19565, 1998.

787. Bondurand, N.; Pingault, V.; Goerich, D. E.; Lemort, N.; Sock, E.; Le Caignec, C.; Wegner, M.; Goossens, M.: Interaction among SOX10, PAX3 and MITF, three genes altered in Waardenburg syndrome. Hum. Molec. Genet. 9: 1907-1917, 2000.
788. Jackson, I. J.; Raymond, S.: Manifestations of microphthalmia. Nature Genet. 8: 209-210, 1994.
789. Lalwani, A. K.; Attaie, A.; Randolph, F. T.; Deshmukh, D.; Wang, C.; Mhatre, A.; Wilcox, E.: Point mutation in the MITF gene causing Waardenburg syndrome type II in a three-generation Indian family. Am. J. Med. Genet. 80: 406-409, 1998.
790. Moore, K. J.: Insight into the microphthalmia gene. Trends Genet. 11:442-448, 1995.
791. Minoshima, S.; Fukuyama, R.; Yamamoto, T.; Shimizu, N.: Mapping of human long-chain acyl-CoA synthetase to chromosome 4. (Abstract) Cytogenet. Cell Genet. 58: 1888 only, 1991.
792. Cantu, E. S.; Sprinkle, T. J.; Ghosh, B.; Singh, I.: The human palmitoyl-CoA ligase (FACL2) gene maps to the chromosome 4q34-q35 region by fluorescence in situ hybridization (FISH) and somatic celihybrid panels. Genomics 28: 600-602, 1995.
793. Rountree, M. R.; Bachman, K. E.; Baylin, S. B.: DNMT1 binds HDAC2 and a new co-repressor, DMAP1, to form a complex at replication foci. Nature Genet. 25: 269-277, 2000.
794. Pyronnet, S.; Imataka, H.; Gingras, A.-C.; Fukunaga, R.; Hunter, T.; Sonenberg, N.: Human eukaryotic translation initiation factor 4G (eIF4G) recruits Mnk1 to phosphorylate eIF4E. EMBO J. 18: 270-279, 1999.
795. Waskiewicz, A. J.; Flynn, A.; Proud, C. G.; Cooper, J. A.: Mitogen-activated protein kinases activate the serine/threonine kinases Mnk1 and Mnk2. EMBO J. 16: 1909-1920, 1997.
796. Zhang, Y.; Saison, M.; Spaepen, M.; De Strooper, B.; Van Leuven, F.; David, G.; Van den Berghe, H.; Cassiman, J.-J.: Mapping of human fibronectin receptor beta subunit gene to chromosome 10. Somat. Cell Molec. Genet. 14: 99-104, 1988.
797. Schoenmakers, E. P. P. M.; Wanschura, S.; Mols, R.; Bullerdiek, J.; Van den Berghe, H.; Van de Ven, W. J. M.: Recurrent rearrangements in the high mobility group protein gene, HMGI-C, in benign mesenchymal tumours. Nature Genet. 10: 436-444, 1995.
798. Beck, Y.; Oren, R.; Amit, B.; Levanon, A.; Gorecki, M.; Hartman, J. R.: Human Mn superoxide dismutase cDNA sequence. Nucleic Acids Res. 15: 9076, 1987.
799. Church, S. L.; Grant, J. W.; Meese, E. U.; Trent, J. M.: Sublocalization of the gene encoding manganese superoxide dismutase (MnSOD/SOD2) to 6q25 by fluorescence in situ hybridization and somatic cell hybrid mapping. Genomics 14: 823-825, 1992.
800. Creagan, R.; Tischfield, J.; Ricciuti, F.; Ruddle, F. H.: Chromosome assignments of genes in man using mouse human somatic cell hybrids: mitochondrial superoxide dismutase (indophenol oxidase-B, tetrameric) to chromosome 6. Humangenetik 20: 203-209, 1973.
801. Figueroa, F.; Vincek, V.; Kasahara, M.; Bell, G. I.; Klein, J.: Mapping of the Sod-2 locus into the t complex on mouse chromosome 17. Immunogenetics 28: 260-264, 1988.
802. Heckl, K.: Isolation of cDNAs encoding human manganese superoxide dismutase. Nucleic Acids Res. 16: 6224, 1988.
803. Li, Y.; Huang, T.-T.; Carlson, E. J.; Melov, S.; Ursell, P. C.; Olson, J. L.; Noble, L. J.; Yoshimura, M. P.; Berger, C.; Chan, P. H.; Wallace, D. C.; Epstein, C. J.: Dilated cardiomyopathy and neonatallethality in mutant mice lacking manganese superoxide dismutase. Nature Genet. 11: 376-381, 1995.
804. Melov, S.; Coskun, P.; Patel, M.; Tuinstra, R.; Cottrell, B.; Jun, A. S.; Zastawny, T. H.; Dizdaroglu, M.; Goodman, S. I.; Huang, T.-T.; Miziorko, H.; Epstein, C. J.; Wallace, D. C.: Mitochondrial disease in superoxide dismutase 2 mutant mice. Proc. Nat. Acad. Sci. 96:846-851, 1999.
805. Melov, S.; Schneider, J. A.; Day, B. J.; Hinerfeld, D.; Coskun, P.; Mirra, S. S.; Crapo, J. D.; Wallace, D. C.: A novel neurological phenotype in mice lacking mitochondrial manganese superoxide dismutase. Nature Genet. 18: 159-163, 1998.
806. Michelson, A. M.; McCord, J. M.; Fridovich, I.: Superoxide and Superoxide Dismutases. New York: Academic Press, 1977.
807. Pauling, L.: The discovery of the superoxide radical. Trends Biochem. Sci. 4(11): 270-271, 1979.
808. Rosenblum, J. S.; Gilula, N. B.; Lerner, R. A.: On signal sequence polymorphisms and diseases of distribution. Proc. Nat. Acad. Sci. 93:4471-4473, 1996.
809. Yoshimitsu, K.; Nichi, Y.; Kobayashi, Y.; Yoshimura, O.; Ohama, K.; Oguma, N.; Usui, T.: Decreased superoxide dismutase-2 activity in a patient with ring chromosome 6. Am. J. Med. Genet. 28: 211-214, 1987.
810. Klugbauer, S.; Rabes, H. M.: The transcription coactivator HTIF1 and a related protein are fused to the RET receptor tyrosine kinase in childhood papillary thyroid carcinomas. Oncogene 18: 4388-4393, 1999.
811. Lairmore, T. C.; Dou, S.; Howe, J. R.; Chi, D.; Carlson, K.; Veile, R.; Mishra, S. K.; Wells, S. A., Jr.; Donis-Keller, H.: A 1.5-megabase yeast artificial chromosome contig from human chromosome 10q11.2 connecting three genetic loci (RET, D10S94, and D10S102) closely linked to the MEN2A locus. Proc. Nat. Acad. Sci. 90: 492-496, 1993.
812. Lombardo, F.; Baudin, E.; Chiefari, E.; Arturi, F.; Bardet, S.; Caillou, B.; Conte, C.; Dallapiccola, B.; Giuffrida, D.; Bidart, J.-M.; Schlumberger, M.; Filetti, S.: Familial medullary thyroid carcinoma: clinical variability and low aggressiveness associated with RET mutation at codon 804. J. Clin. Endocr. Metab. 87: 1674-1680, 2002.
813. Lore, F.; Di Cairano, G.; Talidis, F.: Unilateral renal agenesis in a family with medullary thyroid carcinoma. (Letter) New Eng. J. Med. 342: 1218-1219, 2000.
814. Machens, A.; Gimm, O.; Hinze, R.; Hoppner, W.; Boehm, B. O.; Dralle, H.: Genotype-phenotype correlations in hereditary medullary thyroid carcinoma: oncological features and biochemical properties. J. Clin. Endocr. Metab. 86: 1104-1109, 2001.
815. Mendelsohn, C.; et al; et al: Function of the retinoic acid receptors (RARs) during development (II). Multiple abnormalities at various stages of organogenesis in RAR double mutants. Development 120:2749-2771, 1994.
816. Menko, F. H.; van der Luijt, R. B.; de Valk, I. A. J.; Toorians, A. W. F. T.; Sepers, J. M.; van Diest, P. J.; Lips, C. J. M.: A typical MEN type 2B associated with two germline RET mutations on the same allele not involving codon 918. J. Clin. Endocr. Metab. 87: 393-397, 2002.
817. Mulligan, L. M.; Kwok, J. B. J.; Healey, C. S.; Elsdon, M. J.; Eng, C.; Gardner, E.; Love, D. R.; Mole, S. E.; Moore, J. K.; Papi, L.; Ponder, M. A.; Telenius, H.; Tunnacliffe, A.; Ponder, B. A. J.: Germ-line mutations of the RET proto-oncogene in multiple endocrine neoplasia type 2A. Nature 363: 458-460, 1993.
818. Munnes, M.; Fanaei, S.; Schmitz, B.; Muiznieks, I.; Holschneider, A. M.; Doerfler, W.: Familial form of Hirschsprung disease: nucleotide sequence studies reveal point mutations in the RET proto-oncogenein two of six families but not in other candidate genes. Am. J. Med. Genet. 94: 19-27, 2000.
819. Nakata, T.; Kitamura, Y.; Shimizu, K.; Tanaka, S.; Fujimori, M.; Yokoyama, S.; Ito, K.; Emi, M.: Fusion of a novel gene, ELKS, to RET due to translocation t(10;12)(q11; p13) in a papillary thyroid carcinoma. Genes Chromosomes Cancer 25: 97-103, 1999.
820. Niccoli-Sire, P.; Murat, A.; Rohmer, V.; Franc, S.; Chabrier, G.; Baldet, L.; Maes, B.; Savagner, F.; Giraud, S.; Bezieau, S.; Kottler, M.-L.; Morange, S.; Conte-Devolx, B.: The French Calcitonin Tumors Study Group (GETC).: Familial medullary thyroid carcinoma with noncysteine RET mutations: phenotype-genotype relationship in a large series of patients. J. Clin. Endocr. Metab. 86: 3746-3753, 2001.
821. Pachnis, V.; Mankoo, B.; Costantini, F.: Expression of the c-ret proto-oncogene during mouse embryogenesis. Development 119: 1005-1017, 1993.
822. Pasini, B.; Hofstra, R. M. W.; Yin, L.; Bocciardi, R.; Santamaria, G.; Grootscholten, P. M.; Ceccherini, I.; Patrone, G.; Priolo, M.; Buys, C. H. C. M.; Romeo, G.: The physical map of the human RET proto-oncogene. Oncogene 11:1737-1743, 1995.
823. Pelet, A.; Geneste, O.; Edery, P.; Pasini, A.; Chappuis, S.; Attie, T.; Munnich, A.; Lenoir, G.; Lyonnet, S.; Billaud, M.: Various mechanisms cause RET-mediated signaling defects in Hirschsprung's disease. J. Clin. Invest. 101: 1415-1423, 1998.
824. Pigny, P.; Bauters, C.; Wemeau, J.-L.; Houcke, M. L.; Crepin, M.; Caron, P.; Giraud, S.; Calender, A.; Buisine, M.-P.; Kerckaert, J.-P.; Porchet, N.: A novel 9-base pair duplication in RET exon 8 in familial medullary thyroid carcinoma. J. Clin. Endocr. Metab. 84:1700-1704, 1999.
825. Pierotti, M. A.; Santoro, M.; Jenkins, R. B.; Sozzi, G.; Bongarzone, I.; Grieco, M.; Monzini, N.; Miozzo, M.; Herrmann, M. A.; Fusco, A.; Hay, I. D.; Della Porta, G.; Vecchio, G.: Characterization of an inversion on the long arm of chromosome 10 juxtaposing D10S170 and RET and creating the oncogenic sequence RET/PTC. Proc. Nat. Acad. Sci. 89: 1616-1620, 1992.
826. Rodrigues, G. A.; Park, M.: Dimerization mediated through a leucine zipper activates the oncogenic potential of the met receptor tyrosinekinase. Molec. Cell. Biol. 13: 6711-6722, 1993.
827. Romeo, G.; Ronchetto, P.; Luo, Y.; Barone, V.; Seri, M.; Ceccherini, I.; Pasini, B.; Bocciardi, R.; Lerone, M.; Kaariainen, H.; Martucciello, G.: Point mutations affecting the tyrosine kinase domain of the RET proto-oncogene in Hirschsprung's disease. Nature 367: 377-378, 1994.
828. Salvatore, D.; Barone, M. V.; Salvatore, G.; Melillo, R. M.; Chiappetta, G.; Mineo, A.; Fenzi, G.; Vecchio, G.; Fusco, A.; Santoro, M.: Tyrosines 1015 and 1062 are in vivo autophosphorylation sites in Ret and Ret derived oncoproteins. J. Clin. Endocr. Metab. 85: 3898-3907, 2000.
829. Robinson, M. F.; Cote, G. J.; Nunziata, V.; Brandi, M. L.; Ferrer, J. P.; Martins Bugalho, M. J. G.; Almeida Ruas, M. M.; Chik, C.; Colantuoni, V.; Gagel, R. F.: Mutation of a specific codon of the RET proto-oncogenein the multiple endocrine neoplasia type 2A/cutaneous lichen amyloidosis-syndrome. (Abstract) Fifth International Workshop on Multiple Endocrine Neoplasia, Stockholm, Archipelago, 1994.
830. Klinghoffer, R. A.; Mueting-Nelsen, P. F.; Faerman, A.; Shani, M.; Soriano, P.: The two PDGF receptors maintain conserved signaling in vivo despite divergent embryological functions. Molec. Cell 7:343-354, 2001.
831. Kulkarni, S.; Heath, C.; Parker, S.; Chase, A.; Iqbal, S.; Pocock, C. F.; Kaeda, J.; Cwynarski, K.; Goldman, J. M.; Cross, N. C. P.: Fusion of H4/D10S170 to the platelet-derived growth factor receptor beta in BCR-ABL-negative myeloproliferative disorders with a t(5; 10)(q33;q21). Cancer Res. 60: 3592-3598, 2000.
832. Leal, F.; Williams, L. T.; Robbins, K. C.; Aaronson, S. A.: Evidence that the v-sis gene product transforms by interaction with the receptor for platelet-derived growth factor. Science 230: 327-330, 1985.
833. Matsui, T.; Heidaran, M.; Miki, T.; Popescu, N.; La Rochelle, W.; Kraus, M.; Pierce, J.; Aaronson, S.: Isolation of a novel receptor cDNA establishes the existence of two PDGF receptor genes. Science 243:800-804, 1989.
834. Spies, T.; Blanck, G.; Bresnahan, M.; Sands, J.; Strominger, J. L.: A new cluster of genes within the human major histocompatibility complex. Science 243: 214-217, 1989.
835. Pischel, K. D.; Marlin, S. D.; Springer, T. A.; Woods, V. L., Jr.; Bluestein, H. G.: Polymorphism of lymphocyte function-associated antigen-1 demonstrated by a lupus patient's alloantiserum. J. Clin. Invest. 79: 1607-1614, 1987.
836. Sanchez-Madrid, F.; Nagy, J.; Robbins, E.; Simon, P.; Springer, T. A.: A human leukocyte differentiation antigen family with distinct alpha subunits and a common beta subunit: the lymphocyte function-associated antigen (LFA-1), the C3bi complement receptor (OKM1/Mac-1), and the p150, 95 molecule. J. Exp. Med. 158: 1785-1803, 1983.
837. Inoguchi, K.; Yoshioka, H.; Khaleduzzaman, M.; Ninomiya, Y.: The mRNA for alpha-1(XIX) collagen chain, a new member of FACITs, contains a long unusual 3-prime untranslated region and displays many unique splicing variants. J. Biochem. 117: 137-146, 1995.
838. Khaleduzzaman, M.; Sumiyoshi, H.; Ueki, Y.; Inoguchi, K.; Ninomiya, Y.; Yoshioka, H.: Structure of the human type XIX collagen (COL19A1) gene, which suggests it has arisen from an ancestor gene of the FACIT family. Genomics 45: 304-312, 1997.
839. Myers, J. C.; Sun, M. J.; D'Ippolito, J. A.; Jabs, E. W.; Neilson, E. G.; Dion, A. S.: Human cDNA clones transcribed from an unusually high molecular weight RNA encode a new collagen chain. Gene 123:211-217, 1993.
840. Yoshioka, H.; Zhang, H.; Ramirez, F.; Mattei, M.-G.; Moradi-Ameli, M.; van der Rest, M.; Gordon, M. K.: Synteny between the loci for a novel FACIT-like collagen (D6S228E) and alpha 1(IX) collagen (COL9A1) on 6q12-q14 in humans. Genomics 13: 884-886, 1992.
841. Gerecke, D. R.; Olson, P. F.; Koch, M.; Knoll, J. H. M.; Taylor, R.; Hudson, D. L.; Champliaud, M.-F.; Olsen, B. R.; Burgeson, R. E.: Complete primary structure of two splice variants of collagen XII, and assignment of alpha-1 (XII) collagen (COL12A1), alpha-1(IX) collagen (COL9A1), and alpha-1(XIX) collagen (COL19A1) to human chromosome 6q12-q13. Genomics 41: 236-242, 1997.
842. Yan, B.; Heus, J.; Lu, N.; Nichols, R. C.; Raben, N.; Plotz, P. H.: Transcriptional regulation of the human acid alpha-glucosidase gene: identification of a repressor element and its transcription factors Hes-1 and YY1. J. Biol. Chem. 276: 1789-1793, 2001.
843. Yan, B.; Raben, N.; Plotz, P. H.: Hes-1, a known transcriptional repressor, acts as a transcriptional activator for 843. [continued] the human acid alpha-glucosidase gene in human fibroblast cells. Biochem. Biophys. Res. Commun. 291: 582-587, 2002.

844. Copeland, N. G.; Gilbert, D. J.; Chretien, M.; Seidah, N. G.; Jenkins, N. A.: Regional localization of three convertases, PC1 (Nec-1), PC2(Nec-2), and furin (Fur), on mouse chromosomes. Genomics 13: 1356-1358, 1992.

845. Mbikay, M.; Seidah, N. G.; Chretien, M.; Simpson, E. M.: Chromosomal assignment of the genes for proprotein convertases PC4, PC5, and PACE4 in mouse and human. Genomics 26: 123-129, 1995.

846. Seidah, N. G.; Mattei, M. G.; Gaspar, L.; Benjannet, S.; Mbikay, M.; Chretien, M.: Chromosomal assignments of the genes for neuroendocrine convertase PC1 (NEC1) to human 5q15-21, neuroendocrine convertase PC2 (NEC2) to human 20p1.1-11.2, and furin (mouse 7[D1-E2] region). Genomics 11:103-107, 1991.

847. Hall, C. R.; Cole, W. G.; Haynes, R.; Hecht, J. T.: Reevaluation of a genetic model for the development of exostosis in hereditary multiple exostosis. Am. J. Med. Genet. 112: 1-5, 2002.

848. Sipila, K.; Aula, P.: Database for the mutations of the Finnish disease heritage. Hum. Mutat. 19: 16-22, 2002.

849. Lee, H.-K.; Barbarosie, M.; Kameyama, K.; Bear, M. F.; Huganir, R. L.: Regulation of distinct AMPA receptor phosphorylation sites during bidirectional synaptic plasticity. Nature 405: 955-959, 2000.

850. Mack, V.; Burnashev, N.; Kaiser, K. M. M.; Rozov, A.; Jensen, V.; Hvalby, O.; Seeburg, P. H.; Sakmann, B.; Sprengel, R.: Conditional restoration of hippocampal synaptic potentiation in GluR-A-deficient mice. Science 292: 2501-2504, 2001.

851. Puckett, C.; Gomez, C. M.; Korenberg, J. R.; Tung, H.; Meier, T. J.; Chen, X. N.; Hood, L.: Molecular cloning and chromosomal localization of one of the human glutamate receptor genes. Proc. Nat. Acad. Sci. 88:7557-7561, 1991.

852. Shi, S.-H.; Hayashi, Y.; Petralla, R. S.; Zaman, S. H.; Wenthold, R. J.; Svoboda, K.; Malinow, R.: Rapid spine delivery and redistribution of AMPA receptors after synaptic NMDA receptor activation. Science 284:1811-1816, 1999.

853. Zamanillo, D.; Sprengel, R.; Hvalby, O.; Jensen, V.; Burnashev, N.; Rozov, A.; Kaiser, K. M. M.; Koster, H. J.; Borchardt, T.; Worley, P.; Lubke, J.; Frotscher, M.; Kelly, P. H.; Sommer, B.; Andersen, P.; Seeburg, P. H.; Sakmann, B.: Importance of AMPA receptors for hippocampal synaptic plasticity but not for spatial learning. Science 284:1805-1811, 1999.

854. Berkovitz, G. D.; Guerami, A.; Brown, T. R.; MacDonald, P. C.; Migeon, C. J.: Familial gynecomastia with increased extra glandular aromatization of plasma carbon (19)-steroids. J. Clin. Invest. 75:1763-1769, 1985.

855. Hou, J.; Parrish, J.; Ludecke, H.-J.; Sapru, M.; Wang, Y.; Chen, W.; Hill, A.; Siegel-Bartelt, J.; Northrup, H.; Elder, F. F. B.; Chinault, C.; Horsthemke, B.; Wagner, M. J.; Wells, D. E.: A 4-megabase YAC contig that spans the Langer-Giedion syndrome region on human chromosome 8q24.1: use in refining the location of the trichorhinophalangeal-syndrome and multiple exostoses genes (TRPS1 and EXT1). Genomics 29:87-97, 1995.

856. Ludecke, H.-J.; Wagner, M. J.; Nardmann, J.; La Pillo, B.; Parrish, J. E.; Willems, P. J.; Haan, E. A.; Frydman, M.; Hamers, G. J. H.; Wells, D. E.; Horsthemke, B.: Molecular dissection of a contiguous gene syndrome: localization of the genes involved in the Langer-Giedionsyndrome. Hum. Molec. Genet. 4: 31-36, 1995.

857. Raskind, W. H.; Conrad, E. U., III; Matsushita, M.; Wijsman, E. M.; Wells, D. E.; Chapman, N.; Sandell, L. J.; Wagner, M.; Houck, J.: Evaluation of locus heterogeneity and EXT1 mutations in 34 families with hereditary multiple exostoses. Hum. Mutat. 11: 231-239, 1998.

858. Usala, A.-L.; Madigan, T.; Burguera, B.; Sinha, M. K.; Caro, J. F.; Cunningham, P.; Powell, J. G.; Butler, P. C.: Treatment of insulin-resistant diabetic ketoacidosis with insulin-like growth factor I in an adolescent with insulin-dependent diabetes. New Eng. J. Med. 327: 853-857, 1992.

859. Vaessen, N.; Janssen, J. A.; Heutink, P.; Hofman, A.; Lamberts, S. W. J.; Oostra, B. A.; Pols, H. A. P.; van Duijn, C. M.: Association between genetic variation in the gene for insulin-like growth factor-I and low birth weight. Lancet 359: 1036-1037, 2002.

860. Van Wyk, J. J.; Svoboda, M. E.; Underwood, L. E.: Evidence from radioligand assays that somatomedin-C and insulin-like growth factor-I are similar to each other and different from other somatomedins. J. Clin. Endocr. Metab. 50: 206-208, 1980.

861. Ceccherini, I.; Romei, C.; Barone, V.; Pacini, F.; Martino, E.; Loviselli, A.; Pinchera, A.; Romeo, G.: Identification of the cys634-to-tyr mutation of the RET proto-oncogene in a pedigree with multiple endocrine neoplasia type 2A and localized cutaneous lichen amyloidosis. J. Endocr. Invest. 17: 201-204, 1994.

862. Axton, R.; Hanson, I.; Danes, S.; Sellar, G.; van Heyningen, V.; Prosser, J.: The incidence of PAX6 mutation in patients with simple aniridia: an evaluation of mutation detection in 12 cases. J. Med. Genet. 34: 279-286, 1997.

863. Beauchamp, G. R.: Anterior segment dysgenesis keratolenticular adhesion and aniridia. J. Pediat. Ophthal. Strabismus 17: 55-58, 1978.

864. Crolla, J. A.; Cross, I.; Alkey, N.; Wright, M.; Oley, C. A.: FISH studies in a patient with sporadic aniridia and t(7;11)(q31.2;p13). J. Med. Genet. 33: 66-68, 1996.

865. Fantes, J.; Redeker, B.; Breen, M.; Boyle, S.; Brown, J.; Fletcher, J.; Jones, S.; Bickmore, W.; Fukushima, Y.; Mannens, M.; Danes, S.; van Heyningen, V.; Hanson, I.: Aniridia-associated cytogenetic rearrangements suggest that a position effect may cause the mutant phenotype. Hum. Molec. Genet. 4: 415-422, 1995.

866. Hiroi, S.; Harada, H.; Nishi, H.; Satoh, M.; Nagai, R.; Kimura, A.: Polymorphisms in the SOD2 and HLA-DRB1 genes are associated with nonfamilial idiopathic dilated cardiomyopathy in Japanese. Biochem. Biophys. Res. Commun. 261: 332-339, 1999.

867. Nishi, H.; Koga, Y.; Koyanagi, T.; Harada, H.; Imaizumi, T.; Toshima, H.; Sasazuki, T.; Kimura, A.: DNA typing of HLA class II genes in Japanese patients with dilated cardiomyopathy. J. Molec. Cell. Cardiol. 27:2385-2392, 1995.

868. Xie, W.; Barwick, J. L.; Downes, M.; Blumberg, B.; Simon, C. M.; Nelson, M. C.; Neuschwander-Tetri, B. A.; Brunt, E. M.; Guzelian, P. S.; Evans, R. M.: Humanized xenobiotic response in mice expressing nuclear receptor SXR. Nature 406: 435-439, 2000.

869. Grundmann, U.; Nerlich, C.; Rein, T.; Zettimeissl, G.: Complete cDNA sequence encoding human beta galactoside alpha-2,6-sialyltransferase. Nucleic Acids Res. 18: 667 only, 1990.

870. Wang, X.; Vertino, A.; Eddy, R. L.; Byers, M. G.; Jani-Sait, S. N.; Shows, T. B.; Lau, J. T. Y.: Chromosome mapping and organization of the human beta-galactoside alpha-2,6-sialyltransferase gene: differential and cell-type specific usage of upstream exon sequences in B-lymphoblastoid cells. J. Biol. Chem. 268: 4355-4361, 1993.

871. Brown, D.; Zhu, X. L.; Sly, W. S.: Localization of membrane-associated carbonic anhydrase type IV in kidney epithelial cells. Proc. Nat. Acad. Sci. 87: 7457-7461, 1990.

872. Fleming, R. E.; Crouch, E. C.; Ruzicka, C. A.; Sly, W. S.: Pulmonary carbonic anhydrase IV: developmental regulation and cell-specific expression in the capillary endothelium. Am. J. Physiol. 265: L627-L635, 1993.

873. Fleming, R. E.; Parkkila, S.; Parkkila, A.-K.; Rajaniemi, H.; Waheed, A.; Sly, W. S.: Carbonic anhydrase IV expression in rat and human gastrointestinal tract regional, cellular, and subcellular localization. J. Clin. Invest. 96: 2907-2913, 1995.

874. Ghandour, M. S.; Langley, O. K.; Zhu, X. L.; Waheed, A.; Sly, W. S.: Carbonic anhydrase IV on brain capillary endothelial cells: a marker associated with the blood-brain barrier. Proc. Nat. Acad. Sci. 89: 6823-6827, 1992.

875. Hageman, G. S.; Zhu, X. L.; Waheed, A.; Sly, W. S.: Localization of carbonic anhydrase IV in a specific capillary bed of the human eye. Proc. Nat. Acad. Sci. 88: 2716-2720, 1991.

876. Okuyama, T.; Batanian, J. R.; Sly, W. S.: Genomic organization and localization of gene for human carbonic anhydrase IV to chromosome 17q. Genomics 16: 678-684, 1993.

877. Okuyama, T.; Sato, S.; Zhu, X. L.; Waheed, A.; Sly, W. S.: Human carbonic anhydrase IV: cDNA cloning, sequence comparison, and expression in COS cell membranes. Proc. Nat. Acad. Sci. 89: 1315-1319, 1992.

878. Sender, S.; Gros, G.; Wahleed, A.; Hageman, G. S.; Sly, W. S.: Immunohistochemical localization of carbonic anhydrase IV in capillaries of rat and human skeletal muscle. J. Histochem. Cytochem. 42: 1229-1236, 1994.

879. Wagner, F. F.; Flegel, W. A.: RHD gene deletion occurred in the Rhesus box. Blood 95: 3662-3668, 2000.

880. Roychoudhury, A. K.; Nei, M.: Human Polymorphic Genes: World Distribution. New York: Oxford Univ. Press (pub.) 1988.

881. Rodriguez de Cordoba, S.; Lublin, D. M.; Rubinstein, P.; Atkinson, J. P.: Human genes for three complement components that regulate the activation of C3 are tightly linked. J. Exp. Med. 161: 1189-1195, 1985.

882. Lee, R. T.; Peterson, C. L.; Calman, A. F.; Herskowitz, I.; O'Donnell, J. J.: Cloning of a human galactokinase gene (GK2) on chromosome 15 by complementation in yeast. Proc. Nat. Acad. Sci. 89: 10887-10891, 1992.

883. Pastuszak, I.; O'Donnell, J.; Elbein, A. D.: Identification of the GalNAc kinase amino acid sequence. J. Biol. Chem. 271: 23653-23656, 1996.

884. Synold, T. W.; Dussault, I.; Forman, B. M.: The orphan nuclear receptor SXR coordinately regulates drug metabolism and efflux. Nature Med. 7: 584-590, 2001.

885. Woods, K. A.; Camacho-Hubner, C.; Bergman, R. N.; Barter, D.; Clark, A. J. L.; Savage, M. O.: Effects of insulin-like growth factor I (IGF-I) therapy on body composition and insulin resistance in IGF-I gene deletion. J. Clin. Endocr. Metab. 85: 1407-1411, 2000.

886. Woods, K. A.; Camacho-Hubner, C.; Savage, M. O.; Clark, A. J. L.: Intrauterine growth retardation and postnatal growth failure associated with deletion of the insulin-like growth factor I gene. New Eng. J. Med. 335: 1363-1367, 1996.

887. Yang-Feng, T. L.; Brissenden, J. E.; Ullrich, A.; Francke, U.: Sub-regional localization of human genes for insulin-like growth factors I (IGF1) and II (IGF2) by in situ hybridization. (Abstract) Cytogenet. Cell Genet. 40: 782 only, 1985.

888. Yanovski, J. A.; Sovik, K. N.; Nguyen, T. T.; Sebring, N. G.: Insulin-like growth factors and bone mineral density in African American and white girls. J. Pediat. 137: 826-832, 2000.

889. Zhu, J.; Kahn, C. R.: Analysis of a peptide hormone-receptor interaction in the yeast two-hybrid system. Proc. Nat. Acad. Sci. 94:13063-13068, 1997.

890. Kobayashi, M.; Takamatsu, K.; Saitoh, S.; Miura, M.; Noguchi, T.: Molecular cloning of hippocalcin, a novel calcium-binding protein of the recover in family exclusively expressed in hippocampus. Biochem. Biophys. Res. Commun. 189: 511-517, 1992.

891. Takamatsu, K.; Kobayashi, M.; Saitoh, S.; Fujishiro, M.; Noguchi, T.: Molecular cloning of human hippocalcin cDNA and chromosomal mapping of its gene. Biochem. Biophys. Res. Commun. 200: 606-611, 1994.

892. Borrego, S.; Ruiz, A.; Saez, M. E.; Gimm, O.; Gao, X.; Lopez-Alonso, M.; Hernandez, A.; Wright, F. A.; Antinolo, G.; Eng, C.: RET genotypes comprising specific haplotypes of polymorphic variants predispose to isolated Hirschsprung disease. J. Med. Genet. 37: 572-578, 2000.

893. Borrego, S.; Saez, M. E.; Ruiz, A.; Gimm, O.; Lopez-Alonso, M.; Antinolo, G.; Eng, C.: Specific polymorphisms in the RET proto-oncogene are over-represented in patients with Hirschsprung disease and may represent loci modifying phenotypic expression. J. Med. Genet. 36:771-774, 1999.

894. Iwashita, T.; Murakami, H.; Asai, N.; Takahashi, M.: Mechanism of Ret dysfunction by Hirschsprung mutations affecting its extracellular domain. Hum. Molec. Genet. 5: 1577-1580, 1996.

895. Huguet, E. L.; McMahon, J. A.; McMahon, A. P.; Bicknell, R.; Harris, A. L.: Differential expression of human Wnt genes 2, 3, 4, and 7B in human breast cell lines and normal and disease states of human breast tissue. Cancer Res. 54: 2615-2621, 1994.

896. Nusse, R.; Brown, A.; Papkoff, J.; Scambler, P.; Shackleford, G.; McMahon, A.; Moon, R.; Varmus, H.: A new nomenclature for int-1 and related genes: the Wnt gene family. Cell 64: 231-232, 1991.

897. Yamauchi, M.; Yamauchi, N.; Phear, G.; Spurr, N. K.; Martinsson, T.; Weith, A.; Meuth, M.: Genomic organization and chromosomal localization of the human CTP synthetase gene (CTPS). Genomics 11: 1088-1096, 1991.

898. Courseaux, A.; Grosgeorge, J.; Gaudray, P.; Pannett, A. A. J.; Forbes, S. A.; Williamson, C.; Bassett, D.; Thakker, R. V.; Teh, B. T.; Farnebo, F.; Shepherd, J.; Skogseid, B.; Larsson, C.; Giraud, S.; Zhang, C. X.; Salandre, J.; Calender, A.: Definition of the minimal MEN1 candidate area based on a 5-Mb integrated map of proximal 11q13. Genomics 37:354-365, 1996.

899. Dickson, K. M.; Bergeron, J. J. M.; Shames, I.; Colby, J.; Nguyen, D. T.; Chevet, E.; Thomas, D. Y.; Snipes, G. J.: Association of calnexin with mutant peripheral myelin protein-22 ex vivo: a basis for 'gain-of-function' ER diseases. Proc. Nat. Acad. Sci. 99: 9852-9857, 2002.

900. Gray, P. W.; Byers, M. G.; Eddy, R. L.; Shows, T. B.: The assignment of the calnexin gene to the q35 region of chromosome 5. (Abstract) Human Genome Mapping Workshop 93 9 only, 1993.

901. Schrag, J. D.; Bergeron, J. J. M.; Li, Y.; Borisova, S.; Hahn, M.; Thomas, D. Y.; Cygler, M.: The structure of calnexin, an ER chaperone involved in quality control of protein folding. Molec. Cell 8: 633-644, 2001.

902. Tjoelker, L. W.; Seyfried, C. E.; Eddy, R. L., Jr.; Byers, M. G.; Shows, T. B.; Calderon, J.; Schreiber, R. B.; Gray, P. W.: Human, mouse, and rat calnexin cDNA cloning: identification of potential calcium binding motifs and gene localization to human chromosome 5. Biochemistry 33:3229-3236, 1994.

903. Cyr, C.; Huebner, K.; Druck, T.; Kris, R.: Cloning and chromosomal localization of a human endothelin ETA receptor. Biochem. Biophys. Res. Commun. 181: 184-190, 1991.

904. Hosoda, K.; Nakao, K.; Tamura, N.; Arai, H.; Ogawa, Y.; Suga, S.; Nakanishi, S.; Imura, H.: Organization, structure, chromosomal assignment, and expression of the gene encoding the human endothelin-A receptor. J. Biol. Chem. 267: 18797-18804, 1992.

905. Tzourio, C.; El Amrani, M.; Poirier, O.; Nicaud, V.; Bousser, M.-G.; Alperovitch, A.: Association between migraine and endothelin type A receptor (ETA-231 A/G) gene polymorphism. Neurology 56: 1273-1277, 2001.

906. Carrasquillo, M. M.; McCallion, A. S.; Puffenberger, E. G.; Kashuk, C. S.; Nouri, N.; Chakravarti, A.: Genome-wide association study and mouse model identify interaction between RET and EDNRB pathway sin Hirsch sprung disease. Nature Genet. 32: 237-244, 2002.

907. Denker, S. P.; Huang, D. C.; Orlowski, J.; Furthmayr, H.; Barber, D. L.: Direct binding of the Na—H exchanger NHE1 to ERM proteins regulates the cortical cytoskeleton and cell shape independently of H(+) translocation. Molec. Cell 6: 1425-1436, 2000.

908. Dudley, C. R. K.; Giuffra, L. A.; Tippett, P.; Kidd, K. K.; Reeders, S. T.: The Na+/H+ antiporter: a 'melt' polymorphism allows regional mapping to the short arm of chromosome 1. Hum. Genet. 86: 79-83, 1990.

909. Franchi, A.; Perucca-Lostanlen, D.; Pouyssegur, J.: Functional expression of a human Na+/H+ antiporter gene transfected into antiporter-deficient mouse L cells. Proc. Nat. Acad. Sci. 83: 9388-9392, 1986.

910. Lifton, R. P.; Sardet, C.; Pouyssegur, J.; Lalouel, J.-M.: Cloning of the human genomic amiloride-sensitive Na+/H+ antiporter gene, identification of genetic polymorphisms, and localization on the genetic map of chromosome 1p. Genomics 7: 131-135, 1990.

911. Mattei, M.-G.; Galloni, M.; Sardet, C.; Franchi, A.; Counillon, L.; Passage, E.; Pouyssegur, J.: Localization of the antiporter gene (APNH) and chromosomal homology between human 1p, mouse 4 and Chinese hamster 2q. (Abstract) Cytogenet. Cell Genet. 51: 1041, 1989.

912. Mattei, M.-G.; Sardet, C.; Franchi, A.; Pouyssegur, J.: Chromosomal mapping of the amiloride-sensitive Na+/H+ antiporter gene. (Abstract) Cytogenet. Cell Genet. 46: 658-659, 1987.

913. Mattei, M.-G.; Sardet, C.; Franchi, A.; Pouyssegur, J.: The human amiloride-sensitive Na+/H+ antiporter: localization to chromosome 1 by in situ hybridization. Cytogenet. Cell Genet. 48: 6-8, 1988.

914. Mendoza, S. A.: The Na+/H+ antiport is a mediator of cell proliferation. Acta Paediat. Scand. 76: 545-547, 1987.

915. Morahan, G.; Rakar, S.: Localization of the mouse Na+/H+ exchanger gene on distal chromosome 4. Genomics 15: 231-232, 1993.

916. Sardet, C.; Franchi, A.; Pouyssegur, J.: Molecular cloning, primary structure, and expression of the human growth factor-activatable Na(+)/H(+)antiporter. Cell 56: 271-280, 1989.

917. Whitney, P. L.; Briggle, T. V.: Membrane-associated carbonic an hydrase purified from bovine lung. J. Biol. Chem. 257: 12056-12059, 1982.

918. Zhu, X. L.; Sly, W. S.: Carbonic anhydrase IV from human lung: purification, characterization, and comparison with membrane carbonican hydrase from human kidney. J. Biol. Chem. 265: 8795-8801, 1990.

919. Iwata, N.; Tsubuki, S.; Takaki, Y.; Shirotani, K.; Lu, B.; Gerard, N. P.; Gerard, C.; Hama, E.; Lee, H.-J.; Saido, T. C.: Metabolic regulation of brain A-beta by neprilysin. Science 292: 1550-1552, 2001.

920. McGeer, P. L.; McGeer, E. G.: Polymorphisms in inflammatory genes and the risk of Alzheimer disease. Arch. Neurol. 58: 1790-1792, 2001.

921. Modi, W. S.; Masuda, A.; Yamada, M.; Oppenheim, J. J.; Matsushima, K.; O'Brien, S. J.: Chromosomal localization of the human interleukin 1 alpha (IL-1-alpha) gene. Genomics 2: 310-314, 1988.

922. Mosley, B.; Urdal, D. L.; Prickett, K. S.; Larsen, A.; Cosman, D.; Conlon, P. J.; Gillis, S.; Dower, S. K.: The interleukin-1 receptor binds the human interleukin-1-alpha precursor but not the interleukin-1-beta precursor. J. Biol. Chem. 262: 2941-2944, 1987.

923. Bailly, S.; di Giovine, F. S.; Blakemore, A. I. F.; Duff, G. W.: Genetic polymorphism of human interleukin-1-alpha. Europ. J. Immun. 23:1240-1245, 1993.

924. Boultwood, J.; Breckon, G.; Birch, D.; Cox, R.: Chromosomal localization of murine interleukin-1 alpha and beta genes. Genomics 5: 481-485, 1989.

925. Cox, A.; Camp, N. J.; Cannings, C.; di Giovine, F. S.; Dale, M.; Worthington, J.; John, S.; Ollier, W. E. R.; Silman, A. J.; Duff, G. W.: Combined sib-TDT and TDT provide evidence for linkage of the interleukin-1 gene cluster to erosive rheumatoid arthritis. Hum. Molec. Genet. 8: 1707-1713, 1999.

926. Cox, A.; Camp, N. J.; Nicklin, M. J. H.; di Giovine, F. S.; Duff, G. W.: An analysis of linkage disequilibrium in the interleukin-1 gene cluster, using a novel grouping method for multiallelic markers. Am. J. Hum. Genet. 62: 1180-1188, 1998.

927. Diehl, S. R.; Wang, Y.; Brooks, C. N.; Burmeister, J. A.; Califano, J. V.; Wang, S.; Schenkein, H. A.: Linkage disequilibrium of interleukin-1 genetic polymorphisms with early-onset periodontitis. J. Periodont. 70:418-430, 1999.

928. Du, Y.; Dodel, R. C.; Eastwood, B. J.; Bales, K. R.; Gao, F.; Lohmuller, F.; Muller, U.; Kurz, A.; Zimmer, R.; Evans, R. M.; Hake, A.; Gasser, T.; Oertel, W. H.; Griffin, W. S. T.; Paul, S. M.; Farlow, M. R.: Association of an interleukin 1-alpha polymorphism with Alzheimer's disease. Neurology 55: 480-484, 2000.

929. Furutani, Y.; Notake, M.; Fukui, T.; Ohue, M.; Nomura, H.; Yamada, M.; Nakamura, S.: Complete nucleotide sequence of the gene for human interleukin 1 alpha. Nucleic Acids Res. 14: 3167-3179, 1986.

930. Gray, P. W.; Glaister, D.; Chen, E.; Goeddel, D. V.; Pennica, D.: Two interleukin 1 genes in the mouse: cloning and expression of the cDNA for murine interleukin 1-beta. J. Immun. 137: 3644-3648, 1986.

931. Grimaldi, L. M. E.; Casadei, V. M.; Ferri, C.; Veglia, F.; Licastro, F.; Annoni, G.; Biunno, I.; De Bellis, G.; Sorbi, S.; Mariani, C.; Canal, N.; Griffin, W. S. T.: Association of early-onset Alzheimer's disease with an interleukin-1-alpha gene polymorphism. Ann. Neurol. 47:361-365, 2000.

932. Hogquist, K. A.; Nett, M. A.; Unanue, E. R.; Chaplin, D. D.: Interleukin 1 is processed and released during apoptosis. Proc. Nat. Acad. Sci. 88: 8485-8489, 1991.

933. Hurwitz, A.; Loukides, J.; Ricciarelli, E.; Botero, L.; Katz, E.; McAllister, J. M.; Garcia, J. E.; Rohan, R.; Adashi, E. Y.; Hernandez, E. R.: Human intraovarian interleukin-1 (IL-1) system: highly compartmentalized and hormonally dependent regulation of the genes encoding IL-1, its receptor, and its receptor antagonist. J. Clin. Invest. 89: 1746-1754, 1992.

934. Ki, C.-S.; Na, D. L.; Kim, D. K.; Kim, H. J.; Kim, J.-W.: Lack of association of the interleukin-1-alpha gene polymorphism with Alzheimer's disease in a Korean population. (Letter) Ann. Neurol. 49: 817-818, 2001.

935. Kolsch, H.; Ptok, U.; Bagli, M.; Papassotiropoulos, A.; Schmitz, S.; Barkow, K.; Kockler, M.; Rao, M. L.; Maier, W.; Heun, R.: Genepoly morphisms of interleukin-1-alpha influence the course of Alzheimer's disease. (Letter) Ann. Neurol. 49: 818-819, 2001.

936. Kornman, K. S.; Crane, A.; Wang, H.-Y.; di Giovine, F. S.; Newman, M. G.; Pirk, F. W.; Wilson, T. G., Jr.; Higginbottom, F. L.; Duff, G. W.: The interleukin-1 genotype as a severity factor in adult periodontal disease. J. Clin. Periodont. 24: 72-77, 1997.

937. Lafage, M.; Maroc, N.; Dubreuil, P.; de Waal Malefijt, R.; Pebusque, M.-J.; Carcassonne, Y.; Mannoni, P.: The human interleukin-1-alpha gene is located on the long arm of chromosome 2 at band q13. Blood 73:104-107, 1989.

938. Lord, P. C. W.; Wilmoth, L. M. G.; Mizel, S. B.; McCall, C. E.: Expression of interleukin-1 alpha and beta genes by human blood polymorphonuclear leukocytes. J. Clin. Invest. 87: 1312-1321, 1991.

939. Murphy, G. M., Jr.; Claassen, J. D.; DeVoss, J. J.; Pascoe, N.; Taylor, J.; Tinklenberg, J. R.; Yesavage, J. A.: Rate of cognitive decline in AD is accelerated by the interleukin-1-alpha-889*1 allele. Neurology 56:1595-1597, 2001.

940. Motyckova, G.; Weilbaecher, K. N.; Horstmann, M.; Rieman, D. J.; Fisher, D. Z.; Fisher, D. E.: Linking osteopetrosis and pycnodysostosis: regulation of cathepsin K expression by the microphthalmia transcription factor family. Proc. Nat. Acad. Sci. 98: 5798-5803, 2001.

941. Guillon, H.; de Massy, B.: An initiation site for meiotic crossing-over and gene conversion in the mouse. Nature Genet. 32: 296-299, 2002.

942. Parolini, S.; Bottino, C.; Falco, M.; Augugliaro, R.; Giliani, S.; Franceschini, R.; Ochs, H. D.; Wolf, H.; Bonnefoy, J.-Y.; Biassoni, R.; Moretta, L.; Notarangelo, L. D.; Moretta, A.: X-linked lymphoproliferative disease: 2B4 molecules displaying inhibitory rather than activating function are responsible for the inability of natural killer cells to kill Epstein-Barr virus-infected cells. J. Exp. Med. 192: 337-346, 2000.

943. McPherron, A. C.; Lee, S.-J.: Suppression of body fat accumulation in myostatin-deficient mice. J. Clin. Invest. 109: 595-601, 2002.

944. Attisano, L.; Carcamo, J.; Ventura, F.; Weis, F. M. B.; Massague, J.; Wrana, J. L.: Identification of human activin and TGF-beta type I receptors that form heteromeric kinase complexes with type II receptors. Cell 75:671-680, 1993.

945. Mathews, L. S.; Vale, W. W.: Expression cloning of an activin receptor, a predicted transmembrane serine kinase. Cell 65: 973-982, 1991.

946. Matsuzaki, K.; Xu, J.; Wang, F.; McKeehan, W. L.; Krummen, L.; Kan, M.: A widely expressed transmembrane serine/threonine kinase that does not bind activin, inhibin, transforming growth factor beta, or bone morphogenic factor. J. Biol. Chem. 268: 12719-12723, 1993.

947. Roijer, E.; Miyazono, K.; Astrom, A.-K.; Geurts van Kessel, A.; ten Dijke, P.; Stenman, G.: Chromosomal localization of three human genes encoding members of the TGF-beta superfamily of type I serine/threonine kinase receptors. Mammalian Genome 9: 266-268, 1998.

948. ten Dijke, P.; Ichijo, H.; Franzen, P.; Schulz, P.; Saras, J.; Toyoshima, H.; Heldin, C.-H.; Miyazono, K.: Activin receptor-like kinases: a novel subclass of cell-surface receptors with predicted serine/threonine kinase activity. Oncogene 8: 2879-2887, 1993.

949. Ferguson-Smith, A. C.; Cattanach, B. M.; Barton, S. C.; Beechey, C. V.; Surani, M. A.: Embryological and molecular investigations of parental imprinting on mouse chromosome 7. Nature 351: 667-670, 1991.

950. Chang, T.-M.; Neville, D. M., Jr.: Demonstration of diphtheria toxin receptors on surface membranes from both toxin-sensitive and toxin-resistant species. J. Biol. Chem. 253: 6866-6871, 1978.

951. Creagan, R. P.; Chen, S.-H.; Ruddle, F. H.: Genetic analysis of the cell surface: association of human chromosome 5 with sensitivity to diphtheria toxin in mouse-human somatic cell hybrids. Proc. Nat. Acad. Sci. 72: 2237-2241, 1975.

952. Fen, Z.; Dhadly, M. S.; Yoshizumi, M.; Hilkert, R. J.; Quertermous, T.; Eddy, R. L.; Shows, T. B.; Lee, M.-E.: Structural organization and chromosomal assignment of the gene encoding the human heparin-binding epidermal growth factor-like growth factor/diphtheria toxin receptor. Biochemistry 32:7932-7938, 1993.

953. George, D. L.; Francke, U.: Regional mapping of human genes for hexosaminidase B and diphtheria toxin sensitivity on chromosome 5 using mouse X human hybrid cells. Somat. Cell Genet. 3: 629-638, 1977.

954. Gupta, R. S.; Siminovitch, L.: Isolation and characterization of mutants of human diploid fibroblasts resistant to diphtheria toxin. Proc. Nat. Acad. Sci. 75: 3337-3340, 1978.

955. Hayes, H.; Kaneda, Y.; Uchida, T.; Okada, Y.: Regional assignment of the gene for diphtheria toxin sensitivity using subchromosomal fragments in microcell hybrids. Chromosoma 96: 26-32, 1987.

956. Higashiyama, S.; Abraham, J. A.; Miller, J.; Fiddes, J. C.; Klagsbrun, M.: A heparin-binding growth factor secreted by macrophage-like cells that is related to EGF. Science 251: 936-939, 1991.

957. Demetrick, D. J.; Matsumoto, S.; Hannon, G. J.; Okamoto, K.; Xiong, Y.; Zhang, H.; Beach, D. H.: Chromosomal mapping of the genes for the human cell cycle proteins cyclin C (CCNC), cyclin E (CCNE), p21(CDKN1) and KAP (CDKN3). Cytogenet. Cell Genet. 69: 190-192, 1995.

958. Buonavista, N.; Balzano, C.; Pontarotti, P.; Le Paslier, D.; Golstein, P.: Molecular linkage of the human CTLA4 and CD28 Ig-superfamily genes in yeast artificial chromosomes. Genomics 13: 856-861, 1992.

959. Howard, T. A.; Rochelle, J. M.; Seldin, M. F.: Cd28 and Ctla-4, two related members of the Ig super gene family, are tightly linked on proximal mouse chromosome 1. Immunogenetics 33: 74-76, 1991.

960. Gallagher, P. G.; Forget, B. G.: Structure, organization, and expression of the band 7.2b gene, a candidate gene for hereditary hydrocytosis. J. Biol. Chem. 270: 26358-26363, 1995.

961. Gallagher, P. G.; Romana, M.; Lieman, J. H.; Ward, D. C.: cDNA structure, tissue-specific expression, and chromosomal localization of the murine band 7.2b gene. Blood 86: 359-365, 1995.

962. Gallagher, P. G.; Upender, M.; Ward, D. C.; Forget, B. G.: The gene for human erythrocyte membrane protein band 7.2 (EPB72) maps to 9q33-q34 centromeric to the Philadelphia chromosome translocation breakpoint region. Genomics 18: 167-169, 1993.

963. Hiebl-Dirschmied, C. M.; Entler, B.; Glotzmann, C.; Maurer-Fogy, I.; Stratowa, C.; Prohaska, R.: Cloning and nucleotide sequence of cDNA encoding human erythrocyte band 7 integral membrane protein. Biochim. Biophys. Acta 1090: 123-124, 1991.

964. Pilz, A.; Prohaska, R.; Peters, J.; Abbott, C.: Genetic linkage analysis of the Ak1, Col5a1, Epb7.2, Fpgs, Grp78, Pbx3, and Notch1 genes in the region of mouse chromosome 2 homologous to human chromosome 9q. Genomics 21: 104-109, 1994.

965. Unfried, I.; Entler, B.; Prohaska, R.: The organization of the gene (EPB72) encoding the human erythrocyte band 7 integral membrane protein (protein 7.2b). Genomics 30: 521-528, 1995.

966. Westberg, J. A.; Entler, B.; Prohaska, R.; Schroder, J. P.: The gene coding for erythrocyte protein band 7.2b (EPB72) is located in band q34.1 of human chromosome 9. Cytogenet. Cell Genet. 63: 241-243, 1993.

967. Zhu, Y.; Paszty, C.; Turetsky, T.; Tsai, S.; Kuypers, F. A.; Lee, G.; Cooper, P.; Gallagher, P. G.; Stevens, M. E.; Rubin, E.; Mohandas, N.; Mentzer, W. C.: Stomatocytosis is absent in 'stomatin'-deficient murine red blood cells. Blood 93: 2404-2410, 1999.

968. Lacy, S. E.; Bonnemann, C. G.; Buzney, E. A.; Kunkel, L. M.: Identification of FLRT1, FLRT2, and FLRT3: a novel family of transmembrane leucine-rich repeat proteins. Genomics 62: 417-426, 1999.

969. Horikoshi, N.; Cong, J.; Kley, N.; Shenk, T.: Isolation of differentially expressed cDNAs from p53-dependent apoptotic cells: activation of the human homologue of the *Drosophila peroxidasin* gene. Biochem. Biophys. Res. Commun. 261: 864-869, 1999.

970. Weiler, S. R.; Taylor, S. M.; Deans, R. J.; Kan-Mitchell, J.; Mitchell, M. S.; Trent, J. M.: Assignment of a human melanoma associated gene MG50 (D2S448) to chromosome 2p25.3 by fluorescence in situ hybridization. Genomics 22:243-244, 1994.

971. Betz, R.; Gray, S. G.; Ekstrom, C.; Larsson, C.; Ekstrom, T. J.: Human histone deacetylase 2, HDAC2 (human RPD3), is localized to 6q21 by radiation hybrid mapping. Genomics 52: 245-246, 1998.

972. Inouye, C. J.; Seto, E.: Relief of YY1-induced transcriptional repression by protein-protein interaction with the nuclear phosphoprotein B23. J. Biol. Chem. 269: 6506-6510, 1994.

973. Randhawa, G. S.; Bell, D. W.; Testa, J. R.; Feinberg, A. P.: Identification and mapping of human histone acetylation modifier gene homologues. Genomics 51:262-269, 1998.

974. Yang, W.-M.; Inouye, C.; Zeng, Y.; Bearss, D.; Seto, E.: Transcriptional repression by YY1 is mediated by interaction with a mammalian homolog of the yeast global regulator RPD3. Proc. Nat. Acad. Sci. 93: 12845-12850, 1996.

975. Yarden, R. I.; Brody, L. C.: BRCA1 interacts with components of the histone deacetylase complex. Proc. Nat. Acad. Sci. 96: 4983-4988, 1999.

976. Dermaut, B.; Theuns, J.; Sleegers, K.; Hasegawa, H.; Van den Broeck, M.; Vennekens, K.; Corsmit, E.; St. George-Hyslop, P.; Cruts, M.; van Duijn, C. M.; Van Broeckhoven, C.: The gene encoding nicastrin, a major gamma-secretase component, modifies risk for familial early-onset Alzheimer disease in a Dutch population-based sample. Am. J. Hum. Genet. 70: 1568-1574, 2002.

977. Feldman, R. G.; Chandler, K. A.; Levy, L. L.; Glaser, G. H.: Familial Alzheimer's disease. Neurology 13: 811-824, 1963.

978. Foncin, J.-F.; Salmon, D.; Supino-Viterbo, V.; Feldman, R. G.; Macchi, G.; Mariotti, P.; Scoppetta, C.; Caruso, G.; Bruni, A. C.: Demence presenile d'Alzheimer transmise dans une famille etendue. Rev. Neurol. (Paris) 141: 194-202, 1985.

979. Hiltunen, M.; Mannermaa, A.; Thompson, D.; Easton, D.; Pirskanen, M.; Helisalmi, S.; Koivisto, A. M.; Lehtovirta, M.; Ryynanen, M.; Soininen, H.: Genome-wide linkage disequilibrium mapping of late-onset Alzheimer's disease in Finland. Neurology 57: 1663-1668, 2001.

980. Kehoe, P.; Wavrant-De Vrieze, F.; Crook, R.; Wu, W. S.; Holmans, P.; Fenton, I.; Spurlock, G.; Norton, N.; Williams, H.; Williams, N.; Lovestone, S.; Perez-Tur, J.; Hutton, J.; and 10 others: A full genome scan for late onset Alzheimer disease. Hum. Molec. Genet. 8:237-245, 1999.

981. Kopan, R.; Goate, A.: Aph-2/nicastrin: an essential component of gamma-secretase and regulator of Notch signaling and presenilin localization. Neuron 33: 321-324, 2002.

982. Yu, G.; Nishimura, M.; Arawaka, S.; Levitan, D.; Zhang, L.; Tandon, A.; Song, Y.-Q.; Rogaeva, E.; Chen, F.; Kawarai, T.; Supala, A.; Levesque, L.; and 18 others: Nicastrin modulates presenilin-mediated notch/glp-1 signal transduction and beta-APP processing. Nature 407: 48-54, 2000.

983. Zubenko, G. S.; Hughes, H. B.; Stiffler, J. S.; Hurtt, M. R.; Kaplan, B. B.: A genome survey for novel Alzheimer disease risk loci: result sat 10-cM resolution. Genomics 50: 121-128, 1998.

984. Arakawa, H.; Hauschild, J.; Buerstedde, J.-M.: Requirement of the activation-induced deaminase (AID) gene for immunoglobulin gene conversion. Science 295: 1301-1306, 2002.

985. Fagarasan, S.; Kinoshita, K.; Muramatsu, M.; Ikuta, K.; Honjo, T.: In situ class switching and differentiation to IgA producing cells in the gut lamina propria. Nature 413: 639-643, 2001.

986. Muramatsu, M.; Kinoshita, K.; Fagarasan, S.; Yamada, S.; Shinkai, Y.; Honjo, T.: Class switch recombination and hypermutation require activation-induced cytidine deaminase (AID), a potential RNA editing enzyme. Cell 102: 553-563, 2000.

987. Muramatsu, M.; Sankaranand, V. S.; Anant, S.; Sugai, M.; Kinoshita, K.; Davidson, N. O.; Honjo, T.: Specific expression of activation-induced cytidine deaminase (AID), a novel member of the RNA-editing deaminase family in germinal center B cells. J. Biol. Chem. 274: 18470-18476, 1999.

988. Bak, M.; Hansen, C.; Henriksen, K. F.; Tommerup, N.: The human hedgehog-interacting protein gene: structure and chromosome mapping to 4q31.21-q31.3. Cytogenet. Cell Genet. 92: 300-303, 2001.

989. Chuang, P.-T.; McMahon, A. P.: Vertebrate hedgehog signalling modulated by induction of a hedgehog-binding protein. Nature 397:617-621, 1999.

990. Nakagawa, T.; Setou, M.; Seog, D.-H.; Ogasawara, K.; Dohmae, N.; Takio, K.; Hirokawa, N.: A novel motor, KIF13A, transports mannose-6-phosphate receptor to plasma membrane through direct interaction with AP-1 complex. Cell 103:569-581, 2000.

991. Scott, A. F.: Personal Communication. Baltimore, Md. Nov. 29, 2000.

992. Blumberg, H.; Conklin, D.; Xu, W.; Grossmann, A.; Brender, T.; Carollo, S.; Eagan, M.; Foster, D.; Haldeman, B. A.; Hammond, A.; Haugen, H.; Jelinek, L.; and 14 others: Interleukin 20: discovery, receptor identification, and role in epidermal function. Cell 104:9-19, 2001.

993. Armstrong, E.; Partanen, J.; Cannizzaro, L.; Huebner, K.; Alitalo, K.: Localization of the fibroblast growth factor receptor-4 gene to chromosome region 5q33-qter. Genes Chromosomes Cancer 4: 94-98, 1992.

994. Bange, J.; Prechtl, D.; Cheburkin, Y.; Specht, K.; Harbeck, N.; Schmitt, M.; Knyazeva, T.; Muller, S.; Gartner, S.; Sures, I.; Wang, H.; Imyanitov, E.; Haring, H.-U.; Knayzev, P.; Iacobelli, S.; Hofler, H.; Ullrich, A.: Cancer progression and tumor cell motility are associated with the FGFR4 Arg388 allele. Cancer Res. 62: 840-847, 2002.

995. Holtrich, U.; Brauninger, A.; Strebhardt, K.; Rubsamen-Waigmann, H.: Two additional protein-tyrosine kinases expressed in human lung: fourth member of the fibroblast growth factor receptor family and an intracellular protein-tyrosine kinase. Proc. Nat. Acad. Sci. 88:10411-10415, 1991.

996. Kostrzewa, M.; Muller, U.: Genomic structure and complete sequence of the human FGFR4 gene. Mammalian Genome 9: 131-135, 1998.

997. Partanen, J.; Makela, T. P.; Eerola, E.; Korhonen, J.; Hirvonen, H.; Claesson-Welsh, L.; Alitalo, K.: FGFR-4, a novel acidic fibroblast growth factor receptor with a distinct expression pattern. EMBO J. 10:1347-1354, 1991.

998. Scott, A. F.: Personal Communication. Baltimore, Md. Oct. 12, 1999.

999. Vainikka, S.; Partanen, J.; Bellosta, P.; Coulier, F.; Basilico, C.; Jaye, M.; Alitalo, K.: Fibroblast growth factor receptor-4 shows novel features in genomic structure, ligand binding and signal transduction. EMBO J. 11: 4273-4280, 1992.

1000. Warrington, J. A.; Bailey, S. K.; Armstrong, E.; Aprelikova, O.; Alitalo, K.; Dolganov, G. M.; Wilcox, A. S.; Sikela, J. M.; Wolfe, S. F.; Lovett, M.; Wasmuth, J. J.: A radiation hybrid map of 18 growth factor, growth factor receptor, hormone receptor, or neurotransmitter receptor genes on the distal region of the long arm of chromosomes. Genomics 13: 803-808, 1992.

1001. Ogihara, T.; Isobe, T.; Ichimura, T.; Taoka, M.; Funaki, M.; Sakoda, H.; Onishi, Y.; Inukai, K.; Anai, M.; Fukushima, Y.; Kikuchi, M.; Yazaki, Y.; Oka, Y.; Asano, T.: 14-3-3 protein binds to insulin receptor substrate-1, one of the binding sites of which is in the phosphotyrosine binding domain. J. Biol. Chem. 272: 25267-25274, 1997.

1002. Kumar, S.; McDonnell, P. C.; Lehr, R.; Tierney, L.; Tzimas, M. N.; Griswold, D. E.; Capper, E. A.; Tal-Singer, R.; Wells, G. I.; Doyle, M. L.; Young, P. R.: Identification and initial characterization of four novel members of the interleukin-1 family. J. Biol. Chem. 275:10308-10314, 2000.

1003. Torrents, D.; Estevez, R.; Pineda, M.; Fernandez, E.; Lloberas, J.; Shi, Y.-B.; Zorzano, A.; Palacin, M.: Identification and characterization of a membrane protein (y(+)L amino acid transporter-1) that associates with 4F2hc to encode the amino acid transport activity y(+)L: a candidate gene for lysinuric protein intolerance. J. Biol. Chem. 273: 32437-32445, 1998.

1004. Cohen-Salmon, M.; Frenz, D.; Liu, W.; Verpy, E.; Voegeling, S.; Petit, C.: Fdp, a new fibrocyte-derived protein related to MIA/CD-RAP, has an in vitro effect on the early differentiation of the inner ear mesenchyme. J. Biol. Chem. 275: 40036-40041, 2000.

1005. Rendtorff, N. D.; Frodin, M.; Attie-Bitach, T.; Vekemans, M.; Tommerup, N.: Identification and characterization of an inner ear-expressed human melanoma inhibitory activity (MIA)-like gene (MIAL) with a frequent-polymorphism that abolishes translation. Genomics 71: 40-52, 2001.

1006. Robertson, N. G.; Heller, S.; Lin, J. S.; Resendes, B. L.; Weremowicz, S.; Denis, C. S.; Bell, A. M.; Hudspeth, A. J.; Morton, C. C.: A novel conserved cochlear gene, OTOR: identification, expression analysis, and chromosomal mapping. Genomics 66: 242-248, 2000.

1007. Busfield, S. J.; Comrack, C. A.; Yu, G.; Chickering, T. W.; Smutko, J. S.; Zhou, H.; Leiby, K. R.; Holmgren, L. M.; Gearing, D. P.; Pan, Y.: Identification and gene organization of three novel members of the IL-1 family on human chromosome 2. Genomics 66: 213-216, 2000.

1008. Matsuyoshi, N.; Tanaka, T.; Toda, K.; Imamura, S.: Identification of novel cadherins expressed in human melanoma cells. J. Invest. Derm. 108: 908-913, 1997.

1009. Li, Y.; Chin, L.-S.; Weigel, C.; Li, L.: Spring, a novel RING finger protein that regulates synaptic vesicle exocytosis. J. Biol. Chem. 276: 40824-40833, 2001.

1010. Reymond, A.; Meroni, G.; Fantozzi, A.; Merla, G.; Cairo, S.; Luzi, L.; Riganelli, D.; Zanaria, E.; Messali, S.; Cainarca, S.; Guffanti, A.; Minucci, S.; Pelicci, P. G.; Ballabio, A.: The tripartite motif family identifies cell compartments. EMBO J. 20: 2140-2151, 2001.

1011. Scardigli, R.; Schuurmans, C.; Gradwohl, G.; Guillemot, F.: Cross regulation between neurogenin 2 and pathways specifying neuronal identity in the spinal cord. Neuron 31: 203-217, 2001.

1012. Habas, R.; Kato, Y.; He, X.: Wnt/Frizzled activation of Rho regulates vertebrate gastrulation and requires a novel Form in homology protein Daaml. Cell 107: 843-854, 2001.

1013. Bradley, K. A.; Mogridge, J.; Mourez, M.; Collier, R. J.; Young, J. A. T.: Identification of the cellular receptor for anthrax toxin. Nature 414:160-161, 2001.

1014. Hammarsund, M.; Wilson, W.; Corcoran, M.; Merup, M.; Einhorn, S.; Grander, D.; Sangfelt, O.: Identification and characterization of two novel human mitochondrial elongation factor genes, hEFG2 and hEFG1, phylogenetically conserved through evolution. Hum. Genet. 109: 542-550, 2001.

1015. Ishii, H.; Vecchione, A.; Murakumo, Y.; Baldassarre, G.; Numata, S.; Trapasso, F.; Alder, H.; Baffa, R.; Croce, C. M.: FEZ1/LZTS1 gene at 8p22 suppresses cancer cell growth and regulates mitosis. Proc. Nat. Acad. Sci. 98: 10374-10379, 2001.

1016. Bruick, R. K.; McKnight, S. L.: A conserved family of prolyl-4-hydroxylases that modify HIF. Science 294: 1337-1340, 2001.

1017. Epstein, A. C. R.; Gleadle, J. M.; McNeill, L. A.; Hewitson, K. S.; O'Rourke, J.; Mole, D. R.; Mukherji, M.; Metzen, E.; Wilson, M. I.; Dhanda, A.; Tian, Y.-M.; Masson, N.; Hamilton, D. L.; Jaakkola, P.; Barstead, R.; Hodgkin, J.; Maxwell, P. H.; Pugh, C. W.; Schofield, C. J.; Ratcliffe, P. J.: C. elegans EGL-9 and mammalian homologs define a family of dioxygenases that regulate HIF by prolyl hydroxylation. Cell 107:43-54, 2001.

1018. Bleul, C. C.; Farzan, M.; Choe, H.; Parolin, C.; Clark-Lewis, I.; Sodroski, J.; Springer, T. A.: The lymphocyte chemoattractant SDF-1 is a ligand for LESTR/fusin and blocks HIV-1 entry. Nature 382:829-833, 1996.

1019. Caruz, A.; Samsom, M.; Alonso, J. M.; Alcami, J.; Baleux, F.; Virelizier, J. L.; Parmentier, M.; Arenzana-Seisdedos, F.: Genomic organization and promoter characterization of human CXCR4 gene. FEBS Lett. 426:271-278, 1998.

1020. Clapham, P. R.; Blanc, D.; Weiss, R. A.: Specific cell surface requirements for the infection of CD4-positive cells by human immunodeficiency virus types 1 and 2 and by Simian immunodeficiency virus. Virology 181:703-715, 1991.

1021. Dragic, T.; Alizon, M.: Different requirements for membrane fusion mediated by the envelopes of human immunodeficiency virus types 1 and 2. J. Virol. 67: 2355-2359, 1993.

1022. Federsppiel, B.; Melhado, I. G.; Duncan, A. M. V.; Delaney, A.; Schappert, K.; Clark-Lewis, I.; Jirik, F. R.: Molecular cloning of the cDNA and chromosomal localization of the gene for a putative seven-transmembrane segment (7-TMS) receptor isolated from human spleen. Genomics 16:707-712, 1993.

1023. Feng, Y.; Broder, C. C.; Kennedy, P. E.; Berger, E. A.: HIV-1 entry cofactor: functional cDNA cloning of a seven-transmembrane, G protein-coupled receptor. Science 272: 872-876, 1996.

1024. Hendrix, C. W.; Flexner, C.; MacFarland, R. T.; Giandomenico, C.; Fuchs, E. J.; Redpath, E.; Bridger, G.; Henson, G. W.: Pharmacokinetics and safety of AMD-3100, a novel antagonist of the CXCR-4 chemokine receptor, in human volunteers. Antimicrob. Agents Chemother. 44:1667-1673, 2000.

1025. Herzog, H.; Hort, Y. J.; Shine, J.; Selbie, L. A.: Molecular cloning, characterization, and localization of the human homolog to the reported bovine NPY Y3 receptor: lack of NPY binding and activation. DNA Cell Biol. 12: 465-471, 1993.

1026. Jazin, E. E.; Yoo, H.; Blomqvist, A. G.; Yee, F.; Weng, G.; Walker, M. W.; Salon, J.; Larhammar, D.; Wahlestedt, C.: A proposed bovine neuropeptide Y (NPY) receptor cDNA clone, or its human homologue, confers neither NPY binding sites nor NPY responsiveness on transfected cells. Regul. Pept. 47: 247-258, 1993.

1027. Liotta, L. A.: An attractive force in metastasis. Nature 410:24-25, 2001.

1028. Loetscher, M.; Geiser, T.; O'Reilly, T.; Zwahlen, R.; Baggiolini, M.; Moser, B.: Cloning of a human seven-transmembrane domain receptor, LESTR, that is highly expressed in leukocytes. J. Biol. Chem. 269:232-237, 1994.

1029. Lu, M.; Grove, E. A.; Miller, R. J.: Abnormal development of the hippocampal dentate gyrus in mice lacking the CXCR4 chemokine receptor. Proc. Nat. Acad. Sci. 99: 7090-7095, 2002.

1030. Ma, Q.; Jones, D.; Borghesani, P. R.; Segal, R. A.; Nagasawa, T.; Kishimoto, T.; Bronson, R. T.; Springer, T. A.: Impaired B-lymphopoiesis, myelopoiesis, and derailed cerebellar neuron migration in CXCR4- and SDF-1-deficient mice. Proc. Nat. Acad. Sci. 95: 9448-9453, 1998.

1031. Muller, A.; Homey, B.; Soto, H.; Ge, N.; Catron, D.; Buchanan, M. E.; McClanahan, T.; Murphy, E.; Yuan, W.; Wagner, S. N.; Barrera, J. L.; Mohar, A.; Verastegui, E.; Zlotnik, A.: Involvement of chemokine receptors in breast cancer metastasis. Nature 410: 50-56, 2001.

1032. Nagasawa, T.; Hirota, S.; Tachibana, K.; Takakura, N.; Nishikawa, S.; Kitamura, Y.; Yoshida, N.; Kikutani, H.; Kishimoto, T.: Defects of B-cell lymphopoiesis and bone-marrow myelopoiesis in mice lacking the CXC chemokine PBSF/SDF-1. Nature 382: 635-638, 1996.

1033. Oberlin, E.; Amara, A.; Bachelerie, F.; Bessia, C.; Virelizier, J.-L.; Arenzana-Seisdedos, F.; Schwartz, O.; Heard, J.-M.; Clark-Lewis, I.; Legler, D. F.; Loetscher, M.; Baggiollini, M.; Moser, B.: The CXC chemokine SDF-1 is the ligand for LESTR/fusin and prevents infection by T-cell-line-adapted HIV-1. Nature 382: 833-835, 1996.

1034. Peled, A.; Petit, I.; Kollet, O.; Magid, M.; Ponomaryov, T.; Byk, T.; Nagler, A.; Ben-Hur, H.; Many, A.; Shultz, L.; Lider, O.; Alon, R.; Zipori, D.; Lapidot, T.: Dependence of human stem cell engraftment and repopulation of NOD/SCID mice on CXCR4. Science 283: 845-848, 1999.

1035. Rimland, J.; Xin, W.; Sweetnam, P.; Saijoh, K.; Nestler, E. J.; Duman, R. S.: Sequence and expression of a neuropeptide Y receptor cDNA. Molec. Pharm. 40: 869-875, 1991.

1036. Tachibana, K.; Hirota, S.; Iizasa, H.; Yoshida, H.; Kawabata, K.; Kataoka, Y.; Kitamura, Y.; Matsushima, K.; Yoshida, N.; Nishikawa, S.; Kishimoto, T.; Nagasawa, T.: The chemokine receptor CXCR4 is essential for vascularization of the gastrointestinal tract. Nature 393:591-594, 1998.

1037. Wegner, S. A.; Ehrenberg, P. K.; Chang, G.; Dayhoff, D. E.; Sleeker, A. L.; Michael, N. L.: Genomic organization and functional characterization of the chemokine receptor CXCR4, a major entry co-receptor for human immunodeficiency virus type 1. J. Biol. Chem. 273: 4754-4760, 1998.

1038. Weiner, D. B.; Huebner, K.; Williams, W. V.; Greene, M. I.: Human genes other than CD4 facilitate HIV-1 infection of murine cells. Pathobiology 59:361-371, 1991.

1039. Szostecki, C.; Guldner, H. H.; Netter, H. J.; Will, H.: Isolation and characterization of cDNA encoding a human nuclear antigen predominantly recognized by autoantibodies from patients with primary biliary cirrhosis. J. Immun. 145: 4338-4347, 1990.

1040. Liang, Y.; Buckley, T. R.; Tu, L.; Langdon, S. D.; Tedder, T. F.: Structural organization of the human MS4A gene cluster on chromosome 11q12. Immunogenetics 53: 357-368, 2001.

1041. Tedder, T. F.; Disteche, C. M.; Louie, E.; Adler, D. A.; Croce, C. M.; Schlossman, S. F.; Saito, H.: The gene that encodes the human CD20 (B1) differentiation antigen is located on chromosome 11 near the t(11;14)(q13;q32) translocation site. J. Immun. 142: 2555-2559, 1989.

1042. Tedder, T. F.; Klejman, G.; Schlossman, S. F.; Saito, H.: Structure of the gene encoding the human B lymphocyte differentiation antigen CD20 (B1). J. Immun. 142: 2560-2568, 1989.

1043. Tedder, T. F.; Streuli, M.; Schlossman, S. F.; Saito, H.: Isolation and structure of a cDNA encoding the B1 (CD20) cell-surface antigen of human B lymphocytes. Proc. Nat. Acad. Sci. 85: 208-212, 1988.

1044. Olavesen, M. G.; Bentley, E.; Mason, R. V. F.; Stephens, R. J.; Ragoussis, J.: Fine mapping of 39 ESTs on human chromosome 6p23-p25. Genomics 46:303-306, 1997.

1045. Thaung, C.; West, K.; Clark, B. J.; McKie, L.; Morgan, J. E.; Arnold, K.; Nolan, P. M.; Peters, J.; Hunter, A. J.; Brown, S. D. M.; Jackson, I. J.; Cross, S. H.: Novel ENU-induced eye mutations in the mouse: models for human eye disease. Hum. Molec. Genet. 11:755-767, 2002.

1046. Baumann, C. A.; Ribon, V.; Kanzaki, M.; Thurmond, D. C.; Mora, S.; Shigematsu, S.; Bickel, P. E.; Pessin, J. E.; Saltiel, A. R.: CAP defines a second signalling pathway required for insulin-stimulated glucose transport. Nature 407: 202-207, 2000.

1047. Brissenden, J. E.; Ullrich, A.; Francke, U.: Chromosomal mapping of loci for insulin-like growth factors I and II and for epidermal growth factor in man. (Abstract) Am. J. Hum. Genet. 36: 133S only, 1984.

1048. Brissenden, J. E.; Ullrich, A.; Francke, U.: Human chromosomal mapping of genes for insulin-like growth factors I and II and epidermal growth factor. Nature 310: 781-784, 1984.

1049. Morton, C. C.; Byers, M. G.; Nakai, H.; Bell, G. I.; Shows, T. B.: Human genes for insulin-like growth factors I and II and epidermal growth factor are located on 12q22-q24.1, 11p15, and 4q25-q27, respectively. Cytogenet. Cell Genet. 41: 245-249, 1986.

1050. Ishii, H.; Baffa, R.; Numata, S.-I.; Murakumo, Y.; Rattan, S.; Inoue, H.; Mori, M.; Fidanza, V.; Alder, H.; Croce, C. M.: The FEZ1 gene at chromosome 8p22 encodes a leucine-zipper protein, and its expression is altered in multiple human tumors. Proc. Nat. Acad. Sci. 96: 3928-3933, 1999.

1051. Williamson, J. A.; Bosher, J. M.; Skinner, A.; Sheer, D.; Williams, T.; Hurst, H. C.: Chromosomal mapping of the human and mouse homologues of two new members of the AP-2 family of transcription factors. Genomics 35:262-264, 1996.

1052. Agarwal, V. R.; Ashanullah, C. I.; Simpson, E. R.; Bulun, S. E.: Alternatively spliced transcripts of the aromatase cytochrome P450(CYP19) gene in adipose tissue of women. J. Clin. Endocr. Metab. 82:70-74, 1997.

1053. Yang, R.; Morosetti, R.; Koeffler, H. P.: Characterization of a second human cyclin A that is highly expressed in testis and in several leukemic cell lines. Cancer Res. 57: 913-920, 1997.

1054. Lew, D. J.; Dulic, V.; Reed, S. I.: Isolation of three novel human cyclins by rescue of G1 cyclin (cln) function in yeast. Cell 66:1197-1206, 1991.

1055. Li, H.; Lahti, J. M.; Valentine, M.; Saito, M.; Reed, S. I.; Look, A. T.; Kidd, V. J.: Molecular cloning and chromosomal localization of the human cyclin C (CCNC) and cyclin E (CCNE) genes: deletion of the CCNC gene in human tumors. Genomics 32: 253-259, 1996.

1056. Sheaff, R. J.; Groudine, M.; Gordon, M.; Roberts, J. M.; Clurman, B. E.: Cyclin E-CDK2 is a regulator of p27(Kip1). Genes Dev. 11:1464-1478, 1997.

1057. Akoulitchev, S.; Chuikov, S.; Reinberg, D.: TFIIH is negatively regulated by cdk8-containing mediator complexes. Nature 407: 102-106, 2000.

1058. Trask, B.; Fertitta, A.; Christensen, M.; Youngblom, J.; Bergmann, A.; Copeland, A.; deJong, P.; Mohrenweiser, H.; Olsen, A.; Carrano, A.; Tynan, K.: Fluorescence in situ hybridization mapping of human chromosome 19: cytogenetic band location of 540 cosmids and 70 genes or DNA markers. Genomics 15: 133-145, 1993.

1059. Holland, E. C.; Celestino, J.; Dai, C.; Schaefer, L.; Sawaya, R. E.; Fuller, G. N.: Combined activation of Ras and Akt in neural progenitors induces glioblastoma formation in mice. Nature Genet. 25:55-57, 2000.

1060. Efstratiadis, A.; Posakony, J. W.; Maniatis, T.; Lawn, R. M.; O'Connell, C.; Spritz, R. A.; DeRiel, J. K.; Forget, B. G.; Weissman, S. M.; Slightom, J. L.; Blechl, A. E.; Smithies, O.; Baralle, F. E.; Shoulders, C. C.; Proudfoot, N. J.: The structure and evolution of the human beta-globin gene family. Cell 21: 653-668, 1980.

1061. Doyle, J.; Hoffman, S.; Ucla, C.; Reith, W.; Mach, B.; Stubbs, L.: Locations of human and mouse genes encoding the RFX1 and RFX2 transcription factor proteins. Genomics 35: 227-230, 1996.

1062. Pugliatti, L.; Derre, J.; Berger, R.; Ucla, C.; Reith, W.; Mach, B.: The genes for MHC class II regulatory factors RFX1 and RFX2 are located on the short arm of chromosome 19. Genomics 13: 1307-1310, 1992.

1063. Reith, W.; Ucla, C.; Barras, E.; Gaud, A.; Durand, B.; Herrero-Sanchez, C.; Kobr, M.; Mach, B.: RFX1, a transactivator of hepatitis B virus enhancer 1, belongs to a novel family of homodimeric and heterodimeric DNA-binding proteins. Molec. Cell. Biol. 14: 1230-1244, 1994.

1064. Creutz, C. E.; Tomsig, J. L.; Snyder, S. L.; Gautier, M.-C.; Skouri, F.; Beisson, J.; Cohen, J.: The copines, a novel class of C2 domain-containing, calcium-dependent, phospholipid-binding proteins conserved from Paramecium to humans. J. Biol. Chem. 273: 1393-1402, 1998.

1065. Caudell, E. G.; Caudell, J. J.; Tang, C.-H.; Yu, T.-K.; Frederick, M. J.; Grimm, E. A.: Characterization of human copine III as a phosphoprotein with associated kinase activity. Biochemistry 39: 13034-13043, 2000.

1066. Lai, C.-H.; Chou, C.-Y.; Ch'ang, L.-Y.; Liu, C.-S.; Lin, W.: Identification of novel human genes evolutionarily conserved in Caenorhabditis elegans by comparative proteomics. Genome Res. 10: 703-713, 2000.

1067. Pappu, R.; Cheng, A. M.; Li, B.; Gong, Q.; Chiu, C.; Griffin, N.; White, M.; Sleckman, B. P.; Chan, A. C.: Requirement for B cell linker protein (BLNK) in B cell development. Science 286: 1949-1954, 1999.

1068. Wienands, J.; Schweikert, J.; Wollscheid, B.; Jumaa, H.; Nielsen, P. J.; Reth, M.: SLP-65: a new signaling component in B lymphocytes which requires expression of the antigen receptor for phosphorylation. J. Exp. Med. 188: 791-795, 1998.

1069. Muto, T.; Muramatsu, M.; Taniwaki, M.; Kinoshita, K.; Honjo, T.: Isolation, tissue distribution, and chromosomal localization of the human activation-induced cytidine deaminase (AID) gene. Genomics 68:85-88, 2000.

1070. Geck, P.; Maffini, M. V.; Szelei, J.; Sonnenschein, C.; Soto, A. M.: Androgen-induced proliferative quiescence in prostate cancer cells: the role of AS3 as its mediator. Proc. Nat. Acad. Sci. 97:10185-10190, 2000.

1071. Kas, K.; Finger, E.; Grall, F.; Gu, X.; Akbarali, Y.; Boltax, J.; Weiss, A.; Oettgen, P.; Kapeller, R.; Libermann, T. A.: ESE-3, a novel member of an epithelium-specific Ets transcription factor subfamily, demonstrates different target gene specificity from ESE-1. J. Biol. Chem. 275: 2986-2998, 2000.

1072. Kleinbaum, L. A.; Duggan, C.; Ferreira, E.; Coffey, G. P.; Buttice, G.; Burton, F. H.: Human chromosomal localization, tissue/tumor expression, and regulatory function of the ets family gene EHF. Biochem. Biophys. Res. Commun. 264: 119-126, 1999.

1073. Zhao, L.; Gregoire, F.; Sul, H. S.: Transient induction of ENC-1, a kelch-related actin-binding protein, is required for adipocyte differentiation. J. Biol. Chem. 275: 16845-16850, 2000.

1074. Scott, A. F.: Personal Communication. Baltimore, Md. Oct. 23, 2001.

1075. Woodroofe, M. N.; Tunnacliffe, A.; Pym, B.; Goodfellow, P. N.; Walsh, F. S.: Human muscle cell surface antigen 16-3A5 is encoded by a gene on chromosome 11. Somat. Cell Molec. Genet. 10: 535-540, 1984.

1076. Bilezikian, J. P.; Morishima, A.; Bell, J.; Grumbach, M. M.: Increased bone mass as a result of estrogen therapy in a man with aromatase deficiency. New Eng. J. Med. 339: 599-603, 1998.

1077. Bulun, S. E.: Aromatase deficiency in women and men: would you have predicted the phenotypes? J. Clin. Endocr. Metab. 81: 867-871, 1996.

1078. Carani, C.; Qin, K.; Simoni, M.; Faustini-Fustini, M.; Serpente, S.; Boyd, J.; Korach, K. S.; Simpson, E. R.: Effect of testosterone and estradiol in a man with aromatase deficiency. New Eng. J. Med. 337:91-95, 1997.

1079. Chen, S.; Besman, M. J.; Sparkes, R. S.; Zollman, S.; Klisak, I.; Mohandas, T.; Hall, P. F.; Shively, J. E.: Human aromatase: cDNA cloning, Southern blot analysis, and assignment of the gene to chromosome 15. DNA 7: 27-38, 1988.

1080. Chen, S.; Shively, J. E.; Nakajin, S.; Shinoda, M.; Hall, P. F.: Amino terminal sequence analysis of human placenta aromatase. Biochem. Biophys. Res. Commun. 135: 713-719, 1986.

1081. Conte, F. A.; Grumbach, M. M.; Ito, Y.; Fisher, C. R.; Simpson, E. R.: A syndrome of female pseudohermaphrodism, hypergonadotropichypogonadism, and multicystic ovaries associated with missense mutations in the gene encoding aromatase (P450arom). J. Clin. Endocr. Metab. 78:1287-1292, 1994.

1082. Corbin, C. J.; Graham-Lorence, S.; McPhaul, M.; Mason, J. I.; Mendelson, C. R.; Simpson, E. R.: Isolation of a full-length cDNA insert encoding human aromatase system cytochrome P-450 and its expression in non-steroidogenic cells. Proc. Nat. Acad. Sci. 85: 8948-8952, 1988.

1083. Deladoey, J.; Fluck, C.; Bex, M.; Yoshimura, N.; Harada, N.; Mullis, P. E.: Aromatase deficiency caused by a novel P450(arom) gene mutation: impact of absent estrogen production on serum gonadotropin concentration in a boy. J. Clin. Endocr. Metab. 84: 4050-4054, 1999.

1084. Ellis, J. A.; Stebbing, M.; Harrap, S. B.: Significant population variation in adult male height associated with the Y chromosome and the aromatase gene. J. Clin. Endocr. Metab. 86: 4147-4150, 2001.

1085. Evans, C. T.; Ledesma, D. B.; Schulz, T. Z.; Simpson, E. R.; Mendelson, C. R.: Isolation and characterization of a complementary DNA specific for human aromatase-system cytochrome P-450 mRNA. Proc. Nat. Acad. Sci. 83: 6387-6391, 1986.

1086. Fisher, C. R.; Graves, K. H.; Parlow, A. F.; Simpson, E. R.: Characterization of mice deficient in aromatase (ArKO) because of targeted disruption of the cyp19 gene. Proc. Nat. Acad. Sci. 95:6965-6970, 1998.

1087. George, F. W.; Matsumine, H.; McPhaul, M. J.; Somes, R. G., Jr.; Wilson, J. D.: Inheritance of the henny feathering trait in the Golden Campine chicken: evidence for allelism with the gene that causes henny feathering in the Sebright Bantam. J. Hered. 81: 107-110, 1990.

1088. George, F. W.; Wilson, J. D.: Pathogenesis of the henny feathering trait in the Sebright Bantam chicken. J. Clin. Invest. 66: 57-65, 1980.

1089. Harada, N.: Cloning of a complete cDNA encoding human aromatase: immunochemical identification and sequence analysis. Biochem. Biophys. Res. Commun. 156: 725-732, 1988.

1090. Harada, N.; Ogawa, H.; Shozu, M.; Yamada, K.: Genetic studies to characterize the origin of the mutation in placental aromatase deficiency. Am. J. Hum. Genet. 51: 666-672, 1992.

1091. Harada, N.; Ogawa, H.; Shozu, M.; Yamada, K.; Suhara, K.; Nishida, E.; Takagi, Y.: Biochemical and molecular genetic analyses on placental aromatase (P-450-AROM) deficiency. J. Biol. Chem. 267: 4781-4785, 1992.

1092. Hemsell, D. L.; Edman, C. D.; Marks, J. F.; Siiteri, P. K.; MacDonald, P. C.: Massive extraglandular aromatization of plasma and rostenedione resulting in feminization of a prepubertal boy. J. Clin. Invest. 60:455-464, 1977.

1093. Ito, Y.; Fisher, C. R.; Conte, F. A.; Grumbach, M. M.; Simpson, E. R.: Molecular basis of aromatase deficiency in an adult female with sexual infantilism and polycystic ovaries. Proc. Nat. Acad. Sci. 90: 11673-11677, 1993.

1094. Leiberman, E.; Zachmann, M.: Familial adrenal feminization probably due to increased steroid aromatization. Hormone Res. 37: 96-102, 1992.

1095. Leshin, M.; Baron, J.; George, F. W.; Wilson, J. D.: Increased estrogen formation and aromatase activity in fibroblasts cultured from the skin of chickens with the Henny feathering trait. J. Biol. Chem. 256: 4341-4344, 1981.

1096. Leshin, M.; George, F. W.; Wilson, J. D.: Increased estrogen synthesis in the Sebright bantam is due to a mutation that causes increased aromatase activity. Trans. Assoc. Am. Phys. 94: 97-105, 1981.

1097. Mango, D.; Montemurro, A.; Scirpa, P.; Bompiani, A.; Menini, E.: Four cases of pregnancy with low estrogen production due to placental enzymatic deficiency. Europ. J. Obstet. Gynec. Reprod. Biol. 8:65-71, 1978.

1098. McTernan, P. G.; Anderson. L. A.; Anwar, A. J.; Eggo, M. C.; Crocker, J.; Barnett, A. H.; Stewart, P. M.; Kumar, S.: Glucocorticoid regulation of P450 aromatase activity in human adipose tissue: gender and site differences. J. Clin. Endocr. Metab. 87: 1327-1336, 2002.

1099. Morishima, A.; Grumbach, M. M.; Simpson, E. R.; Fisher, C.; Qin, K.: Aromatase deficiency in male and female siblings caused by a novel mutation and the physiological role of estrogens. J. Clin. Endocr. Metab. 80: 3689-3698, 1995.

1100. Mullis, P. E.; Yoshimura, N.; Kuhlmann, B.; Lippuner, K.; Jaeger, P.; Harada, H.: Aromatase deficiency in a female who is compound heterozygote for two new point mutations in the P450(arom) gene: impact of estrogens on hypergon adotropic hypogonadism, multicystic ovaries, and bone densitometry in childhood. J. Clin. Endocr. Metab. 82:1739-1745, 1997.

1101. Phornphutkul, C.; Okubo, T.; Wu, K.; Harel, Z.; Tracy, T. F. Jr.; Pinar, H.; Chen, S.; Gruppuso, P. A.; Goodwin, G.: Aromatase P450 expression in a feminizing adrenal adenoma presenting as isosexual precocious puberty. J. Clin. Endocr. Metab. 86: 649-652, 2001.

1102. Robertson, K. M.; O'Donnell, L.; Jones, M. E. E.; Meachem, S. J.; Boon, W. C.; Fisher, C. R.; Graves, K. H.; McLachlan, R. I.; Simpson, E. R.: Impairment of spermatogenesis in mice lacking a functional aromatase (cyp 19) gene. Proc. Nat. Acad. Sci. 96: 7986-7991, 1999.

1103. Sebastian, S.; Bulun, S. E.: A highly complex organization of the regulatory region of the human CYP19 (aromatase) gene revealed by the Human Genome Project. J. Clin. Endocr. Metab. 86: 4600-4602, 2001.

1104. Everman, D. B.; Bartels, C. F.; Yang, Y.; Yanamandra, N.; Goodman, F. R.; Mendoza-Londono, J. R.; Savarirayan, R.; White, S. M.; Graham, J. M., Jr.; Gale, R. P.; Svarch, E.; Newman, W. G.; Kleckers, A. R.; Francomano, C. A.; Govindaiah, V.; Singh, L.; Morrison, S.; Thomas, J. T.; Warman, M. L.: The mutational spectrum of brachydactyly type C. Am. J. Med. Genet. 112: 291-296, 2002.

1105. Galjaard, R. J. H.; van der Ham, L. I.; Posch, N. A. S.; Dijkstra, P. F.; Oostra, B. A.; Hovius, S. E. R.; Timmenga, E. J. F.; Sonneveld, G. J.; Hoogeboom, A. J. M.; Heutink, P.: Differences in complexity of isolated brachydactyly type C cannot be attributed to locus heterogeneity alone. Am. J. Med. Genet. 98: 256-262, 2001.

1106. Haws, D. V.: Inherited brachydactyly and hypoplasia of the bones of the extremities. Ann. Hum. Genet. 26: 201-212, 1963.

1107. Polinkovsky, A.; Robin, N. H.; Thomas, J. T.; Irons, M.; Lynn, A.; Goodman, F. R.; Reardon, W.; Kant, S. G.; Brunner, H. G.; vander Burgt, I.; Chitayat, D.; McGaughran, J.; Donnai, D.; Luyten, F. P.; Warman, M. L.: Mutations in CDMP1 cause autosomal dominant brachydactyly type C. (Letter) Nature Genet. 17: 18-19, 1997.

1108. Polymeropoulos, M. H.; Ide, S. E.; Magyari, T.; Francomano, C. A.: Brachydactyly type C gene maps to human chromosome 12q24. Genomics 38:45-50, 1996.

1109. Robin, N. H.; Gunay-Aygun, M.; Polinkovsky, A.; Warman, M. L.; Morrison, S.: Clinical and locus heterogeneity in brachydactyly type C. Am. J. Med. Genet. 68: 369-377, 1997.

1110. Storm, E. E.; Huynh, T. V.; Copeland, N. G.; Jenkins, N. A.; Kingsley, D. M.; Lee, S. J.: Limb alterations in brachypodism mice due to mutation sin a new member of the TGF-beta superfamily. Nature 368: 639-643, 1994.

1111. Zetterstrom, R. H.; Solomin, L.; Jansson, L.; Hoffer, B. J.; Olson, L.; Perlmann, T.: Dopamine neuron agenesis in Nurr1-deficient mice. Science 276:248-250, 1997.

1112. Koi, M.; Johnson, L. A.; Kalikin, L. M.; Little, P. F. R.; Nakamura, Y.; Feinberg, A. P.: Tumor cell growth arrest caused by subchromosomal transferable DNA fragments from chromosome 11. Science 260: 361-364, 1993.

1113. Tsavaler, L.; Shapero, M. H.; Morkowski, S.; Laus, R.: Trp-p8, a novel prostate-specific gene, is up-regulated in prostate cancer and other malignancies and shares high homology with transient receptor potential calcium channel proteins. Cancer Res. 61: 3760-3769, 2001.

1114. Hu, R.-J.; Lee, M. P.; Connors, T. D.; Johnson, L. A.; Burn, T. C.; Su, K.; Landes, G. M.; Feinberg, A. P.: A 2.5-Mb transcript map of a tumor-suppressing subchromosomal transferable fragment from 11p15.5, and isolation and sequence analysis of three novel genes. Genomics 46:9-17, 1997.

1115. Schmidt, A.; Wolde, M.; Thiele, C.; Fest, W.; Kratzin, H.; Podtelejnikov, A. V.; Witke, W.; Huttner, W. B.; Soling, H.-D.: Endophilin I mediates synaptic vesicle formation by transfer of arachidonate to lysophosphatidic acid. Nature 401: 133-141, 1999.

1116. Nagase, T.; Ishikawa, K.; Suyama, M.; Kikuno, R.; Hirosawa, M.; Miyajima, N.; Tanaka, A.; Kotani, H.; Nomura, N.; Ohara, O.: Prediction of the coding sequences of unidentified human genes. XII. The complete sequences of 100 new cDNA clones from brain which code for large proteins in vitro. DNA Res. 5: 355-364, 1998.

1117. Dent, A. L.; Yewdell, J.; Puvion-Dutilleul, F.; Koken, M. H.; deThe, H.; Staudt, L. M.: LYSP100 associated nuclear domains (LANDs): description of a new class of subnuclear structures and their relationship to PML nuclear bodies. Blood 88: 1423-1426, 1996.

1118. Seeler, J. S.; Marchio, A.; Sitterlin, D.; Transy, C.; Dejean, A.: Interaction of SP100 with HP1 proteins: a link between the promyelocytic leukemia-associated nuclear bodies and the chromatin compartment. Proc. Nat. Acad. Sci. 95: 7316-7321, 1998.

1119. Bahary, N.; Zorich, G.; Pachter, J. E.; Leibel, R. L.; Friedman, J. M.: Molecular genetic linkage maps of mouse chromosomes 4 and 6. Genomics 11: 33-47, 1991.

1120. Callen, D. F.; Chen, L. Z.; Nancarrow, J.; Whitmore, S. A.; Apostolou, S.; Thompson, A. D.; Lane, S. A.; Stallings, R. L.; Hildebrand, C. E.; Harris, P. G.; Sutherland, G. R.: Current state of the physical map of human chromosome 16. (Abstract) Cytogenet. Cell Genet. 58:1998 only, 1991.

1121. Corbi, A. L.; Larson, R. S.; Kishimoto, T. K.; Springer, T. A.; Morton, C. C.: Chromosomal location of the genes encoding the leukocyte adhesion receptors LFA-1, Mac-1 and p150,95: identification of a gene cluster involved in cell adhesion. J. Exp. Med. 167: 1597-1607, 1988.

1122. Amagai, M.; Klaus-Kovtun, V.; Stanley, J. R.: Autoantibodies against a novel epithelial cadherin in pemphigus vulgaris, a disease of cell adhesion. Cell 67: 869-877, 1991.

1123. Koch, P. J.; Mahoney, M. G.; Ishikawa, H.; Pulkkinen, L.; Uitto, J.; Schultz, L.; Murphy, G. F.; Whitaker-Menezes, D.; Stanley, J. R.: Targeted disruption of the pemphigus vulgaris antigen (desmoglein3) gene in mice causes loss of keratinocyte cell adhesion with a phenotype similar to pemphigus vulgaris. J. Cell Biol. 137: 1091-1102, 1997.

1124. Wang, Y.; Amagai, M.; Minoshima, S.; Sakai, K.; Green, K. J.; Nishikawa, T.; Shimizu, N.: The human genes for desmogleins (DSG1 and DSG3) are located in a small region on chromosome 18q12. Genomics 20:492-495, 1994.

1125. DerKinderen, D. J.; Koten, J. W.; Tan, K. E. W. P.; Beemer, F. A.; Van Romunde, L. K. J.; Den Otter, W.: Parental age in sporadic hereditary retinoblastoma. Am. J. Ophthal. 110: 605-609, 1990.

1126. Friedman, L. S.; Ostermeyer, E. A.; Lynch, E. D.; Welcsh, P.; Szabo, C. I.; Meza, J. E.; Anderson, L. A.; Dowd, P.; Lee, M. K.; Rowell, S. E.; Ellison, J.; Boyd, J.; King, M.-C.: 22 genes from chromosome 17q21: cloning, sequencing, and characterization of mutations in breast cancer families and tumors. Genomics 25: 256-163, 1995.

1127. Linial, M.; Miller, K.; Scheller, R. H.: VAT-1: an abundant membrane protein from Torpedo cholinergic synaptic vesicles. Neuron 2: 1265-1273, 1989.

1128. Smith, T. M.; Lee, M. K.; Szabo, C. I.; Jerome, N.; McEuen, M.; Taylor, M.; Hood, L.; King, M.-C.: Complete genomic sequence and analysis of 117 kb of human DNA containing the gene BRCA1. Genome Res. 6: 1029-1049, 1996.

1129. Bause, E.; Bieberich, E.; Rolfs, A.; Volker, C.; Schmidt, B.: Molecular cloning and primary structure of Man(9)-mannosidase from human kidney. Eur. J. Biochem. 217: 535-540, 1993.

1130. Tremblay, L. O; Campbell Dyke, N.; Herscovics, A.: Molecular cloning, chromosomal mapping and tissue specific expression of a novel human alpha-1,2-mannosidase gene involved in N-glycan maturation. Glycobiology 8:585-595, 1998.

1131. Hubener, C.; Mincheva, A.; Lichter, P.; Schraven, B.; Bruyns, E.: Genomic organization and chromosomal localization of the human gene encoding the T-cell receptor-interacting molecule (TRIM). Immunogenetics 51:154-158, 2000.

1132. Bruyns, E.; Marie-Cardine, A.; Kirchgessner, H.; Sagolla, K.; Shevchenko, A.; Mann, M.; Autschbach, F.; Bensussan, A.; Meuer, S.; Schraven, B.: T cell receptor (TCR) interacting molecule (TRIM), a novel disulfide-linked dimer associated with the TCR-CD3-zeta complex, recruits intracellular signaling proteins to the plasma membrane. J. Exp. Med. 188: 561-575, 1998.

1133. Zhao, R.; Qi, Y.; Chen, J.; Zhao, Z. J.: FYVE-DSP2, a FYVE domain-containing dual specificity protein phosphatase that dephosphorylates phosphotidylinositol (sic) 3-phosphate. Exp. Cell Res. 265: 329-338, 2001.

1134. Frye, R. A.: Characterization of five human cDNAs with homology to the yeast SIR2 gene: Sir2-like proteins (sirtuins) metabolize NAD and may have protein ADP-ribosyltransferase activity. Biochem. Biophys. Res. Commun. 260: 273-279, 1999.

1135. Imai, S.; Armstrong, C. M.; Kaeberlein, M.; Guarente, L.: Transcriptional silencing and longevity protein Sir2 is an NAD-dependent histone deacetylase. Nature 403:795-800, 2000.

1136. Kimura, A.; Umehara, T.; Horikoshi, M.: Chromosomal gradient of histone acetylation established by Sas2p and Sir2p functions as a shield against gene silencing. Nature Genet. 15 Oct.: 2002. Note: Advance Electronic Publication.

1137. Fedi, P.; Bafico, A.; Soria, A. N.; Burgess, W. H.; Miki, T.; Bottaro, D. P.; Kraus, M. H.; Aaronson, S. A.: Isolation and biochemical characterization of the human Dkk-1 homologue, a novel inhibitor of mammalian Wnt signaling. J. Biol. Chem. 274: 19465-19472, 1999.

1138. Krupnik, V. E.; Sharp, J. D.; Jiang, C.; Robison, K.; Chickering, T. W.; Amaravadi, L.; Brown, D. E.; Guyot, D.; Mays, G.; Leiby, K.; Chang, B.; Duong, T.; Goodearl, A. D. J.; Gearing, D. P.; Sokol, S. Y.; McCarthy, S. A.: Functional and structural diversity of the human Dickkopf gene family. Gene 238: 301-313, 1999.

1139. Roessler, E.; Du, Y.; Glinka, A.; Dutra, A.; Niehrs, C.; Muenke, M.: The genomic structure, chromosome location, and analysis of the human DKK1 head inducer gene as a candidate for holoprosencephaly. Cytogenet. Cell Genet. 89: 220-224, 2000.

1140. Lebre, A.-S.; Jamot, L.; Takahashi, J.; Spasskey, N.; Leprince, C.; Ravise, N.; Zander, Fujigasaki, H.; Kussel-Andermann, P.; Duyckaerts, C.; Camonis, J. H.; Brice, A.: Ataxin-7 interacts with a Cbl-associated protein that it recruits into neuronal intranuclear inclusions. Hum. Molec. Genet. 10: 10:-1201-1213, 2001.

1141. Lin, W.-H.; Chiu, K. C.; Chang, H.-M.; Lee, K.-C.; Tai, T.-Y.; Chuang, L.-M.: Molecular scanning of the human sorbin and SH3-domain-containing-1(SORBS1) gene: positive association of the T228A polymorphism with obesity and type 2 diabetes. Hum. Molec. Genet. 10: 1753-1760, 2001.

1142. Scott, A. F.: Personal Communication. Baltimore, Md. Sep. 13, 2000.

1143. Luo, J.; Nikolaev, A. Y.; Imai, S.; Chen, D.; Su, F.; Shiloh, A.; Guarente, L.; Gu, W.: Negative control of p53 by Sir2-alpha promotes cell survival under stress. Cell 107: 137-148, 2001.

1144. Shore, D.; Squire, M.; Nasmyth, K. A.: Characterization of two genes required for the position-effect control of yeast mating-type genes. EMBO J. 3: 2817-2823, 1984.

1145. Suka, N.; Luo, K.; Grunstein, M.: Sir2p and Sas2p opposingly regulate acetylation of yeast histone H4 lysine 16 and spreading of heterochromatin. Nature Genet. 15 Oct.: 2002. Note: Advance Electronic Publication.

1146. Tanny, J. C.; Dowd, G. J.; Huang, J.; Hilz, H.; Moazed, D.: An enzymatic activity in the yeast Sir2 protein that is essential for gene silencing. Cell 99: 735-745, 1999.

1147. Vaziri, H.; Dessain, S. K.; Eaton, E. N.; Imai, S.-I.; Frye, R. A.; Pandita, T. K.; Guarente, L.; Weinberg, R. A.: hSIR2-SIRT1 functions as an NAD-dependent p53 deacetylase. Cell 107: 149-159, 2001.

1148. Liu, J.; Shworak, N. W.; Sinay, P.; Schwartz, J. J.; Zhang, L.; Fritze, L. M.; Rosenberg, R. D.: Expression of heparan sulfate D-glucosaminyl3-O-sulfotransferase isoforms reveals novel substrate specificities. J. Biol. Chem. 274: 5185-5192, 1999.

1149. Shworak, N. W.; Liu, J.; Petros, L. M.; Zhang, L.; Kobayashi, M.; Copeland, N. G.; Jenkins, N. A.; Rosenberg, R. D.: Multiple isoforms of heparan sulfate D-glucosaminyl 3-O-sulfotransferase: isolation, characterization, and expression of human cDNAs and identification of distinct genomic loci. J. Biol. Chem. 274: 5170-5184, 1999.

1150. Michel, J. J.; Xiong, Y.: Human CUL-1, but not other cullin family members, selectively interacts with SKP1 to form a complex with SKP2 and cyclin A. Cell Growth Differ. 9: 435-449, 1998.

1151. Du, M.; Sansores-Garcia, L.; Zu, Z.; Wu, K. K.: Cloning and expression analysis of a novel salicylate suppressible gene, Hs-CUL-3, a member of cullin/Cdc53 family. J. Biol. Chem. 273: 24289-24292, 1998.

1152. Bao, S.; Shen, X.; Shen, K.; Liu, Y.; Wang, X.-F.: The mammalian Rad24 homologous to yeast *Saccharomyces cerevisiae* Rad24 and *Schizosaccharomyces pombe* Rad17 is involved in DNA damage checkpoint. Cell Growth Diff. 9:961-967, 1998.

1153. Bao, S.; Chang, M.-S.; Auclair, D.; Sun, Y.; Wang, Y.; Wong, W.-K.; Zhang, J.; Liu, Y.; Qian, X.; Sutherland, R.; Magi-Galluzi, C.; Weisberg, E.; Cheng, E. Y. S.; Hao, L.; Sasaki, H.; Campbell, M. S.; Kraeft, S.-K.; Loda, M.; Lo, K.-M.; Chen, L. B.: Hrad17, a human homologue of the *Schizosaccharomyces pombe* checkpoint gene rad17, is overexpressed in colon carcinoma. Cancer Res. 59: 2023-2028, 1999.

1154. Bluyssen, H. A. R.; Naus, N. C.; van Os, R. I.; Jaspers, I.; Hoeijmakers, J. H. J.; de Klein, A.: Human and mouse homologues of the *Schizosaccharomyces pombe* rad17+ cell cycle checkpoint control gene. Genomics 55: 219-228, 1999.

1155. Boyer, S. H.; Fainer, D. C.; Watson-Williams, E. J.: Lactate dehydrogenasevariant from human blood: evidence for molecular subunits. Science 141:642-643, 1963.

1156. Delmas, B.; Gelfi, J.; L'Haridon, R.; Vogel, L. K.; Sjostrom, H.; Noren, O.; Laude, H.: Aminopeptidase N is a major receptor for the enteropathogenic coronavirus TGEV. Nature 357: 417-420, 1992.

1157. Kruse, T. A.; Bolund, L.; Grzeschik, K.-H.; Ropers, H. H.; Olsen, J.; Sjostrom, H.; Noren, O.: Assignment of the human aminopeptidase N (peptidase E) gene to chromosome 15q13-qter. FEBS Lett. 239: 305-308, 1988.

1158. Look, A. T.; Ashmun, R. A.; Shapiro, L. H.; Peiper, S. C.: Human myeloid plasma membrane glycoprotein CD13 (gp150) is identical to aminopeptidase N. J. Clin. Invest. 83: 1299-1307, 1989.

1159. Look, A. T.; Peiper, S. C.; Rebentisch, M. B.; Ashmun, R. A.; Roussel, M. F.; Lemons, R. S.; Le Beau, M. M.; Rubin, C. M.; Sherr, C. J.: Molecular cloning, expression, and chromosomal localization of the gene encoding a human myeloid membrane antigen (gp150). J. Clin. Invest. 78: 914-921, 1986.

1160. Watt, V. M.; Willard, H. F.: The human aminopeptidase N gene: isolation, chromosome localization, and DNA polymorphism analysis. Hum. Genet. 85: 651-654, 1990.

1161. Yeager, C. L.; Ashmun, R. A.; Williams, R. K.; Cardellichio, C. B.; Shapiro, L. H.; Look, A. T.; Holmes, K. V.: Human aminopeptidase N is a receptor for human coronavirus 229E. Nature 357: 420-422, 1992.

1162. Santoro, M.; Carlomagno, F.; Hay, I. D.; Herrmann, M. A.; Grieco, M.; Melillo, R.; Pierotti, M. A.; Bongarzone, I.; Della Porta, G.; Berger, N.; Peix, J. L.; Paulin, C.; Fabien, N.; Vecchio, G.; Jenkins, R. B.; Fusco, A.: Ret oncogene activation in human thyroid neoplasms is restricted to the papillary cancer subtype. J. Clin. Invest. 89:1517-1522, 1992.

1163. Santoro, M.; Carlomagno, F.; Romano, A.; Bottaro, D. P.; Dathan, N. A.; Grieco, M.; Fusco, A.; Vecchio, G.; Matoskova, B.; Kraus, M. H.; Di Fiore, P. P.: Activation of RET as a dominant transforming gene by germline mutations of MEN2A and MEN2B. Science 267: 381-383, 1995.

1164. Schuchardt, A.; D'Agati, V.; Larsson-Blomberg, L.; Costantini, F.; Pachnis, V.: Defects in the kidney and enteric nervous system of mice lacking the tyrosine kinase receptor Ret. Nature 367: 380-383, 1994.

1165. Shirahama, S.; Ogura, K.; Takami, H.; Ito, K.; Tohsen, T.; Miyauchi, A.; Nakamura, Y.: Mutational analysis of the RET proto-oncogene in 71 Japanese patients with medullary thyroid carcinoma. J. Hum. Genet. 43:101-106, 1998.

1166. Seri, M.; Yin, L.; Barone, A.; Bolino, A.; Celli, I.; Bocciardi, R.; Pasini, B.; Ceccherini, I.; Lerone, M.; Kristoffersson, U.; Larsson, L. T.; Casasa, J. M.; Cass, D. T.; Abramowicz, M. J.; Vanderwinden, J.-M.; Kravcenkiene, I.; Baric, I.; Silengo, M.; Martucciello, G.; Romeo, G.: Frequency of RET mutations in long- and short-segment Hirschsprung disease. Hum. Mutat. 9: 243-249, 1997.

1167. Takahashi, M.; Buma, Y.; Hiai, H.: Isolation of ret proto-oncogene cDNA with an amino-terminal signal sequence. Oncogene 4: 805-806, 1989.

1168. Takahashi, M.; Buma, Y.; Iwamoto, T.; Inaguma, Y.; Ikeda, H.; Hiai, H.: Cloning and expression of the ret proto-oncogene encoding a tyrosine kinase with two potential transmembrane domains. Oncogene 3:571-578, 1988.

1169. Takahashi, M.; Ritz, J.; Cooper, G. M.: Activation of a novel human transforming gene, ret, by DNA rearrangement. Cell 42: 581-588, 1985.

1170. Tessitore, A.; Sinisi, A. A.; Pasquali, D.; Cardone, M.; Vitale, D.; Bellastella, A.; Colantuoni, V.: A novel case of multiple endocrine neoplasia type 2A associated with two de novo mutations of the RET protooncogene. J. Clin. Endocr. Metab. 84: 3522-3527, 1999.

1171. van Heyningen, V.: One gene—four syndromes. Nature 367: 319-320, 1994.

1172. Xue, F.; Yu, H.; Maurer, L. H.; Memoli, V. A.; Nutile-McMenemey, N.; Schuster, M. K.; Bowden, D. W.; Mao, J.; Noll, W. W.: Germline RET mutations in MEN 2A and FMTC and their detection by simple DNA diagnostic tests. Hum. Molec. Genet. 3: 635-638, 1994.

1173. Yin, L.; Ceccherini, I.; Pasini, B.; Matera, I.; Bicocchi, M. P.; Barone, V.; Bocciardi, R.; Kaariainen, H.; Weber, D.; Devoto, M.; Romeo, G.: Close linkage with the RET protooncogene and boundaries of deletion mutations in autosomal dominant Hirschsprung disease. Hum. Molec. Genet. 2: 1803-1808, 1993.

1174. Berger, A.; Rosenthal, D.; Spiegel, S.: Sphingosylphosphocholine, a signaling molecule which accumulates in Niemann-Pick disease type A, stimulates DNA-binding activity of the transcription activator protein AP-1. Proc. Nat. Acad. Sci. 92: 5885-5889, 1995.

1175. Bohmann, D.; Bos, T. J.; Admon, A.; Nishimura, T.; Vogt, P. K.; Tjian, R.: Human proto-oncogene c-jun encodes a DNA binding protein with structural and functional properties of transcription factor AP-1. Science 238: 1386-1392, 1987.

1176. Bos, T. J.; Bohmann, D.; Tsuchie, H.; Tjian, R.; Vogt, P. K.: v-jun encodes a nuclear protein with enhancer binding properties of AP-1. Cell 52: 705-712, 1988.

1177. Haluska, F. G.; Huebner, K.; Isobe, M.; Nishimura, T.; Croce, C. M.; Vogt, P. K.: Localization of the human JUN protooncogene to chromosome region 1p31-32. Proc. Nat. Acad. Sci. 85: 2215-2218, 1988.

1178. Hattori, K.; Angel, P.; Le Beau, M. M.; Karin, M.: Structure and chromosomal localization of the functional intronless human JUN protooncogene. Proc. Nat. Acad. Sci. 85: 9148-9152, 1988.

1179. Lamph, W. W.; Wamsley, P.; Sassone-Corsi, P.; Verma, I. M.: Induction of proto-oncogene JUN/AP-1 by serum and TPA. Nature 334: 629-631, 1988.

1180. Marx, J. L.: 'Jun' is bustin' out all over. (Research News). Science 242:1377-1378, 1988.

1181. Mattei, M. G.; Simon-Chazottes, D.; Hirai, S.-I.; Ryseck, R.-P.; Galcheva-Gargova, Z.; Guenet, J. L.; Mattei, J. F.; Bravo, R.; Yaniv, M.: Chromosomal localization of the three members of the jun proto-oncogene family in mouse and man. Oncogene 5: 151-156, 1990.

1182. Shaulian, E.; Karin, M.: AP-1 as a regulator of cell life and death. Nature Cell Biol. 4: E131-E136, 2002.

1183. Shaulian, E.; Schreiber, M.; Piu, F.; Beeche, M.; Wagner, E. F.; Karin, M.: The mammalian UV response: c-Jun induction is required for exit from p53-imposed growth arrest. Cell 103: 897-907, 2000.

1184. Whyte, J. R. C.; Munro, S.: The Sec34/35 Golgi transport complex is related to the exocyst, defining a family of complexes involved in multiple steps of membrane traffic. Dev. Cell 1: 527-537, 2001.

1185. Hoefler, G.; Forstner, M.; McGuinness, M. C.; Hulla, W.; Hiden, M.; Krisper, P.; Kenner, L.; Ried, T.; Lengauer, C.; Zechner, R.; mOser, H. W.; Chen, G. L.: cDNA cloning of the human peroxisomalenoyl-CoA hydratase: 3-hydroxyacyl-CoA dehydrogenase bifunctional enzyme and localization to chromosome 3q26.3-3q28: a free left Alu arm is inserted in the 3-prime noncoding region. Genomics 19: 60-67, 1994.

1186. Nagle, D. L.; McGrail, S. H.; Vitale, J.; Woolf, E. A.; Dussault, B. J., Jr.; DiRocco, L.; Holmgren, L.; Montagno, J.; Bork, P.; Huszar, D.; Fairchild-Huntress, V.; Ge, P.; Keilty, J.; Ebelling, C.; Baldini, L.; Gilchrist, J.; Burr, P.; Carlson, G. A.; Moore, K. J.: The mahogany protein is a receptor involved in suppression of obesity. Nature 398: 148-151, 1999.

1187. Maas, S.; Gerber, A. P.; Rich, A.: Identification and characterization of a human tRNA-specific adenosine deaminase related to the ADAR family of pre-mRNA editing enzymes. Proc. Nat. Acad. Sci. 96: 8895-8900, 1999.

1188. Zou, Y.-R.; Kottmann, A. H.; Kuroda, M.; Taniuchi, I.; Littman, D. R.: Function of the chemokine receptor CXCR4 in haematopoiesis and in cerebellar development. Nature 393: 595-599, 1998.

1189. Apiou, F.; Flagiello, D.; Cillo, C.; Malfoy, B.; Poupon, M.-F.; Dutrillaux, B.: Fine mapping of human HOX gene clusters. Cytogenet. Cell Genet. 73: 114-115, 1996.

1190. Brown, C. W.; Houston-Hawkins, D. E.; Woodruff, T. K.; Matzuk, M. M.: Insertion of Inhbb into the lnhba locus rescues the Inhba-null phenotype and reveals new activin functions. Nature Genet. 25: 453-457, 2000.

1191. Ferguson, C. A.; Tucker, A. S.; Christensen, L.; Lau, A. L.; Matzuk, M. M.; Sharpe, P. T.: Activin is an essential early mesenchymal signal in tooth development that is required for patterning of the murine dentition. Genes Dev. 12: 2636-2649, 1998.

1192. Burger, H. G.; Igarashi, M.; Baird, D.; Mason, T.; Bardin, W.; McLachlan, R.; Chappel, S.; Miyamoto, K.; de Jong, F.; Moudgal, A.; Demoulin, A.; Nieschlag, E.; de Kretser, D.; Robertson, D.; Findlay, J.; Sasamoto, S.; Forage, R.; Schwartz, N.; Fukuda, M.; Steinberger, A.; Hasegawa, Y.; Tanabe, K.; Ling, N.; Ying, S.-Y.: Inhibin: definition and nomenclature, including related substances. (Letter) J. Clin. Endocr. Metab. 66: 885-886, 1988.

1193. Lumpkin, M. D.; Moltz, J. H.; Yu, W. H.; Samson, W. K.; McCann, S. M.: Purification of FSH-releasing factor: its dissimilarity from LHRH of mammalian, avian, and piscian origin. Brain Res. Bull. 18:175-178, 1987.

1194. Matzuk, M. M.; Kumar, T. R.; Vassalli, A.; Bickenbach, J. R.; Roop, D. R.; Jaenisch, R.; Bradley, A.: Functional analysis of activins during mammalian development. Nature 374: 354-356, 1995.

1195. Mellor, S. L.; Cranfield, M.; Ries, R.; Pedersen, J.; Cancilla, B.; de Kretser, D.; Groome, N. P.; Mason, A. J.; Risbridger, G. P.: Localization of activin beta(A)-, beta (B)-, and beta(C)-subunits in human prostate and evidence for formation of new activin heterodimers of beta(C)-subunit. J. Clin. Endocr. Metab. 85: 4851-4858, 2000.

1196. Murata, M.; Eto, Y.; Shibai, H.; Sakai, M.; Muramatsu, M.: Erythroid differentiation factor is encoded by the same mRNA as that of the inhibin beta-A chain. Proc. Nat. Acad. Sci. 85: 2434-2438, 1988.

1197. You, L.; Kruse, F. E.: Differential effect of activin A and BMP-7 on myofibroblast differentiation and the role of the Smad signaling pathway. Invest. Ophthal. Vis. Sci. 43: 72-81, 2002.

1198. Dustin, M. L.; Olszowy, M. W.; Holdorf, A. D.; Li, J.; Bromley, S.; Desai, N.; Widder, P.; Rosenberger, F.; van der Merwe, P. A.; Allen, P. M.; Shaw, A. S.: A novel adaptor protein orchestrates receptor patterning and cytoskeletal polarity in T-cell contacts. Cell 94:667-677, 1998.

1199. Kirsch, K. H.; Georgescu, M.-M.; Ishimaru, S.; Hanafusa, H.: CMS: an adapter molecule involved in cytoskeletal rearrangements. Proc. Nat. Acad. Sci. 96: 6211-6216, 1999.

1200. Shih, N.-Y.; Li, J.; Karpitskii, V.; Nguyen, A.; Dustin, M. L.; Kanagawa, O.; Miner, J. H.; Shaw, A. S.: Congenital nephrotic syndrome in mice lacking CD2-associated protein. Science 286: 312-315, 1999.

1201. Matsumoto-Taniura, N.; Pirollet, F.; Monroe, R.; Gerace, L.; Westendorf, J. M.: Identification of novel M phase phosphoproteins by expression cloning. Molec. Biol. Cell 7: 1455-1469, 1996.

1202. Beckstead, R.; Ortiz, J. A.; Sanchez, C.; Prokopenko, S. N.; Chambon, P.; Losson, R.; Bellen, H. J.: Bonus, a *Drosophila* homolog of TIF1 proteins, interacts with nuclear receptors and can inhibit beta-FTZ-F1-dependent transcription. Molec. Cell 7: 753-765, 2001.

1203. Le Douarin, B.; Zechel, C.; Garnier, J.-M.; Lutz, Y.; Tora, L.; Pierrat, B.; Heery, D.; Gronemeyer, H.; Chambon, P.; Losson, R.: The N-terminal part of TIF1, a putative mediator of the ligand-dependent activation function (AF-2) of nuclear receptors, is fused to B-rafin the oncogenic protein T18. EMBO J. 14: 2020-2033, 1995.

1204. Thenot, S.; Henriquet, C.; Rochefort, H.; Cavailles, V.: Differential interaction of nuclear receptors with the putative human transcriptional coactivator hTIF1. J. Biol. Chem. 272: 12062-12068, 1997.

1205. Feral, C.; Mattei, M. G.; Pawlak, A.; Guellaen, G.: Chromosomal localization of three human poly(A)-binding protein genes and four related pseudo genes. Hum. Genet. 105: 347-353, 1999.

1206. Houng, A. K.; Maggini, L.; Clement, C. Y.; Reed, G. L.: Identification and structure of activated-platelet protein-1, a protein with RNA-binding domain motifs that is expressed by activated platelets. Europ. J. Biochem. 243: 209-218, 1997.

1207. Yang, H.; Duckett, C. S.; Lindsten, T.: iPABP, an inducible poly(A)-binding protein detected in activated human T cells. Molec. Cell. Biol. 15:6770-6776, 1995.

1208. Blagitko, N.; Schulz, U.; Schinzel, A. A.; Ropers, H.-H.; Kalscheuer, V. M.: Gamma-2-COP, a novel imprinted gene on chromosome 7q32, defines a new imprinting cluster in the human genome. Hum. Molec. Genet. 8:2387-2396, 1999.

1209. Taylor, S. S.; Ha, E.; McKeon, F.: The human homologue of Bub3 is required for kinetochore localization of Bub1 and a Mad3/Bub1-related protein kinase. J. Cell Biol. 142: 1-11, 1998.

1210. Bergstein, I.; Eisenberg, L. M.; Bhalerao, J.; Jenkins, N. A.; Copeland, N. G.; Osborne, M. P.; Bowcock, A. M.; Brown, A. M. C.: Isolation of two novel WNT genes, WNT14 and WNT15, one of which (WNT15) is closely linked to WNT3 on human chromosome 17q21. Genomics 46:450-458, 1997.

1211. Hartman n, C.; Tabin, C. J.: Wnt-14 plays a pivotal role in inducing synovial joint formation in the developing appendicular skeleton. Cell 104:341-351, 2001.

1212. Saitoh, T.; Hirai, M.; Katoh, M.: Molecular cloning and characterization of WNT3A and WNT14 clustered in human chromosome 1q42 region. Biochem. Biophys. Res. Commun. 284: 1168-1175, 2001.

1213. Kullak-Ublick, G.-A.; Beuers, U.; Meier, P. J.; Domdey, H.; Paumgartner, G.: Assignment of the human organic anion transporting polypeptide (OATP) gene to chromosome 12p12 by fluorescence in situ hybridization. J. Hepatol. 25: 985-987, 1996.

1214. Kullak-Ublick, G. A.; Hagenbuch, B.; Stieger, B.; Schteingart, C. D.; Hofmann, A. F.; Wolkoff, A. W.; Meier, P. J.: Molecular and functional characterization of an organic anion transporting polypeptide cloned from human liver.: Gastroenterology 109: 1274-1282, 1995.

1215. Zheng, B.; Larkin, D. W.; Albrecht, U.; Sun, Z. S.; Sage, M.; Eichele, G.; Lee, C. C.; Bradley, A.: The mPer2 gene encodes a functional component of the mammalian circadian clock. Nature 400: 169-173, 1999.

1216. Nakamura, H.; Sudo, T.; Tsuiki, H.; Miyake, H.; Morisaki, T.; Sasaki, J.; Masuko, N.; Kochi, M.; Ushio, Y.; Saya, H.: Identification of a novel human homolog of the *Drosophila* dig, P-dig, specifically expressed in the gland tissues and interacting with p55. FEBS Lett. 433: 63-67, 1998.

1217. Funderburgh, J. L.; Perchellet, A. L.; Swiergiel, J.; Conrad, G. W.; Justice, M. J.: Keratocan (Kera), a corneal keratan sulfate proteoglycan, maps to the distal end of mouse chromosome 10. Genomics 52: 110-111, 1998.

1218. Liu, C.-Y.; Shiraishi, A.; Kao, C. W.-C.; Converse, R. L.; Funderburgh, J. L.; Corpuz, L. M.; Conrad, G. W.; Kao, W. W.-Y.: The cloning of mouse keratocan cDNA and genomic DNA and the characterization of its expression during eye development. J. Biol. Chem. 273: 22584-22588, 1998.

1219. Tasheva, E. S.; Funderburgh, J. L.; Funderburgh, M. L.; Corpuz, L. M.; Conrad, G. W.: Structure and sequence of the gene encoding human keratocan. DNA Seq. 10: 67-74, 1999.

1220. Tasheva, E. S.; Pettenati, M.; Von Kap-Her, C.; Conrad, G. W.: Assignment of keratocan gene (KERA) to human chromosome band 12q22 by in situ hybridization. Cytogenet. Cell Genet. 88: 244-245, 2000.

1221. Duncan, L. M.; Deeds, J.; Hunter, J.; Shao, J.; Holmgren, L. M.; Woolf, E. A.; Tepper, R. I.; Shyjan, A. W.: Down-regulation of the novel gene melastatin correlates with potential for melanoma metastasis. Cancer Res. 58: 1515-1520, 1998.

1222. Fang, D.; Setaluri, V.: Expression and up-regulation of alternatively spliced transcripts of melastatin, a melanoma metastasis-related gene, in human melanoma cells. Biochem. Biophys. Res. Commun. 279: 53-61, 2000.

1223. Hunter, J. J.; Shao, J.; Smutko, J. S.; Dussault, B. J.; Nagle, D. L.; Woolf, E. A.; Holmgren, L. M.; Moore, K. J.; Shyjan, A. W.: Chromosomal localization and genomic characterization of the mouse melastatin gene (Mlsn1). Genomics 54: 116-123, 1998.

1224. Xu, X. Z.; Moebius, F.; Gill, D. L.; Montell, C.: Regulation of melastatin, a TRP-related protein, through interaction with a cytoplasmic isoform. Proc. Nat. Acad. Sci. 98: 10692-10697, 2001.

1225. Kalitsis, P.; Earle, E.; Fowler, K. J.; Choo, K. H. A.: Bub3 gene disruption in mice reveals essential mitotic spindle checkpoint function during early embryogenesis. Genes Dev. 14: 2277-2282, 2000.

1226. van Hille, B.; Richener, H.; Evans, D. B.; Green, J. R.; Bilbe, G.: Identification of two subunit A isoforms of the vacuolar H(+)-ATPase in human osteoclastoma. J. Biol. Chem. 268: 7075-7080, 1993.

1227. van Hille, B.; Richener, H.; Green, J. R.; Bilbe, G.: The ubiquitous VA68 isoform of subunit A of the vacuolar H(+)-ATPase is highly expressed in human osteoclasts. Biochem. Biophys. Res. Commun. 214: 1108-1113, 1995.

1228. Liang, T. W.; Chiu, H. H.; Gurney, A.; Sidle, A.; Tumas, D. B.; Schow, P.; Foster, J.; Klassen, T.; Dennis, K.; DeMarco, R. A.; Pham, T.; Frantz, G.; Fong, S.: Vascular endothelial-junctional adhesion molecule (VE-JAM)/JAM 2 interacts with T, NK, and dendritic cells through JAM 3. J. Immun. 168: 1618-1626, 2002.

1229. Arrate, M. P.; Rodriguez, J. M.; Tran, T. T.; Brock, T. A.; Cunningham, S. A.: Cloning of human junctional adhesion molecule 3 (JAM3) and its identification as the JAM2 counter-receptor. J. Biol. Chem. 276:45826-45832, 2001.

1230. Parker, A. E.; Van de Weyer, I.; Laus, M. C.; Verhasselt, P.; Luyten, W. H. M. L.: Identification of a human homologue of the *Schizosaccharomyces pombe* rad17+ checkpoint gene. J. Biol. Chem. 273: 18340-18346, 1998. Note: Erratum: J. Biol. Chem. 274: 24438-24439, 1999.

1231. von Deimling, F.; Scharf, J. M.; Liehr, T.; Rothe, M.; Kelter, A.-R.; Albers, P.; Dietrich, W. F.; Kunkel, L. M.; Wernert, N.; Wirth, B.: Human and mouse RAD17 genes: identification, localization, genomic structure and histological expression pattern in normal testis and seminoma. Hum. Genet. 105: 17-27, 1999.

1232. Thomas, M. K.; Yao, K.-M.; Tenser, M. S.; Wong, G. G.; Habener, J. F.: Bridge-1, a novel PDZ-domain coactivator of E2A-mediated regulation of insulin gene transcription. Molec. Cell. Biol. 19: 8492-8504, 1999.

1233. Watanabe, T. K.; Saito, A.; Suzuki, M.; Fujiwara, T.; Takahashi, E.; Slaughter, C. A.; DeMartino, G. N.; Hendil, K. B.; Chung, C. H.; Tanahashi, N.; Tanaka, K.: cDNA cloning and characterization of a human proteasomal modulator subunit, p27 (PSMD9). Genomics 50: 241-250, 1998.

1234. Fu, C.; Turck, C. W.; Kurosaki, T.; Chan, A. C.: BLNK: a central linker protein in B cell activation. Immunity 9: 93-103, 1998.

1235. Ishiai, M.; Kurosaki, M.; Pappu, R.; Okawa, K.; Ronko, I.; Fu, C.; Shibata, M.; Iwamatsu, A.; Chan, A. C.; Kurosaki, T.: BLNK required for cloning Syk to PLC-gamma-2 and Rac1-JNK in B cells. Immunity 10:117-125, 1999.

1236. Minegishi, Y.; Rohrer, J.; Coustan-Smith, E.; Lederman, H. M.; Pappu, R.; Campana, D.; Chan, A. C.; Conley, M. E.: An essential role for BLNK in human B cell development. Science 286: 1954-1957, 1999.

1237. DeVry, C. G.; Clarke, S.: Assignment of the protein L-isoaspartate (D-aspartate) O-methyltransferase gene (PCMT1) to human chromosome bands 6q24-q25 with radiation hybrid mapping. Cytogenet. Cell Genet. 84:130-131, 1999.

1238. Farrar, C.; Clarke, S.: Altered levels of S-adenosylmethionine and S-adenosylhomocysteine in the brains of L-isoaspartyl (D-aspartyl)O-methyltransferase-deficient mice. J. Biol. Chem. 277: 27856-27863, 2002.

1239. Ingrosso, D.; Kagan, R. M.; Clarke, S.: Distinct C-terminal sequences of isozymes I and II of the human erythrocyte L-isoaspartyl/D-aspartyl protein methyltransferase. Biochem. Biophys. Res. Commun. 175: 351-358, 1991.

1240. Kim, E.; Lowenson, J. D.; Clarke, S.; Young, S. G.: Phenotypic analysis of seizure-prone mice lacking L-isoaspartate (D-aspartate)O-methyltransferase. J. Biol. Chem. 274: 20671-20678, 1999.

1241. Lowenson, J. D.; Kim, E.; Young, S. G.; Clarke, S.: Limited accumulation of damaged proteins in L-isoaspartyl (D-aspartyl) O-methyltransferase-deficient mice. J. Biol. Chem. 276: 20695-20702, 2001.

1242. MacLaren, D. C.; Kagan, R. M.; Clarke, S.: Alternative splicing of the human isoaspartyl protein carboxyl methyltransferase leads to the generation of a C-terminal-RDEL sequence in isozyme II. Biochem. Biophys. Res. Commun. 185: 277-283, 1992.

1243. MacLaren, D. C.; O'Connor, C. M.; Xia, Y.-R.; Mehrabian, M.; Klisak, I.; Sparkes, R. S.; Clarke, S.; Lusis, A. J.: The L-isoaspartyl/D-aspartyl protein methyltransferase gene (PCMT1) maps to human chromosome 6q22.3-6q24 and the syntenic region of mouse chromosome 10. Genomics 14: 852-856, 1992.

1244. Ota, I. M.; Gilbert, J. M.; Clarke, S.: Two major isozymes of the protein D-aspartyl/L-isoaspartyl methyltransferase from human erythrocytes. Biochem. Biophys. Res. Commun. 151: 1136-1143, 1988.

1245. Hunter, A. G. W.; Clifford, B.; Cox, D. M.: The characteristic physiognomy and tissue specific karyotype distribution in the Pallister-Killian syndrome. Clin. Genet. 28: 47-53, 1985.

1246. Astrom, A.-K.; Voz, M. L.; Kas, K.; Roijer, E.; Wedell, B.; Mandahl, N.; Van de Ven, W.; Mark, J.; Stenman, G.: Conserved mechanism of PLAG1 activation in salivary gland tumors with and without chromosome 8q12 abnormalities: identification of SII as a new fusion partner gene. Cancer Res. 59: 918-923, 1999.

1247. Singh, S.; Chao, L. Y.; Mishra, R.; Davies, J.; Saunders, G. F.: Missense mutation at the C-terminus of PAX6 negatively modulates homeodomain function. Hum. Molec. Genet. 10: 911-918, 2001.

1248. Singh, S.; Mishra, R.; Arango, N. A.; Deng, J. M.; Behringer, R. R.; Saunders, G. F.: Iris hypoplasia in mice that lack the alternatively spliced Pax6(5a) isoform. Proc. Nat. Acad. Sci. 99: 6812-6815, 2002.

1249. Singh, S.; Tang, H. K.; Lee, J.-Y.; Saunders, G. F.: Truncation mutations in the transactivation region of PAX6 result in dominant-negative mutants. J. Biol. Chem. 273: 21531-21541, 1998.

1250. Ton, C. C. T.; Miwa, H.; Saunders, G. F.: Small eye (Sey): cloning and characterization of the murine homolog of the human aniridia gene. Genomics 13:251-256, 1992.

1251. Walther, C.; Gruss, P.: Pax-6, a murine paired box gene, is expressed in the developing CNS. Development 113: 1435-1449, 1991.

1252. Wawersik, S.; Maas, R. L.: Vertebrate eye development as modeled in *Drosophila*. Hum. Molec. Genet. 9: 917-925, 2000.

1253. Lee, D. K.; George, S. R.; Cheng, R.; Nguyen, T.; Liu, Y.; Brown, M.; Lynch, K. R.; O'Dowd, B. F.: Identification of four novel human G protein-coupled receptors expressed in the brain. Molec. Brain Res. 86: 13-22, 2001.

1254. Cikos, S.; Gregor, P.; Koppel, J.: Cloning of a novel biogenicamine receptor-like G protein-coupled receptor expressed in human brain. Biochim. Biophys. Acta 1521: 66-72, 2001.

1255. Chen, C.-K.; Zhang, K.; Church-Kopish, J.; Huang, W.; Zhang, H.; Chen, Y.-J.; Frederick, J. M.; Baehr, W.: Characterization of human GRK7 as a potential cone opsin kinase. Molec. Vision 7: 305-313, 2001.

1256. Weiss, E. R.; Ducceschi, M. H.; Horner, T. J.; Li, A.; Craft, C. M.; Osawa, S.: Species-specific differences in expression of G-protein-coupled receptor kinase (GRK) 7 and GRK1 in mammalian cone photoreceptor cells: implications for cone cell phototransduction. J. Neurosci. 21: 9175-9184, 2001.
1257. Borregaard, N.; Cowland, J. B.: Granules of the human neutrophilic polymorphonuclear leukocyte. Blood 89: 3503-3521, 1997.
1258. Chang, K. S.; Schroeder, W.; Siciliano, M. J.; Thompson, L. H.; McCredie, K.; Beran, M.; Freireich, E. J.; Liang, J. C.; Trujillo, J. M.; Stass, S. A.: The localization of the human myeloperoxidase gene is in close proximity to the translocation breakpoint in acute promyelocytic leukemia. Leukemia 1: 458-462, 1987.
1259. DeLeo, F. R.; Goedken, M.; McCormick, S. J.; Nauseef, W. M.: A novel form of hereditary myeloperoxidase deficiency linked to endoplasmic reticulum/proteasome degradation. J. Clin. Invest. 101: 2900-2909, 1998.
1260. Eiserich, J. P.; Baldus, S.; Brennan, M.-L.; Ma, W.; Zhang, C.; Tousson, A.; Castro, L.; Lusis, A. J.; Nauseef, W. M.; White, C. R.; Freeman, B. A.: Myeloperoxidase, a leukocyte-derived vascular NO oxidase. Science 296: 2391-2394, 2002.
1261. Inazawa, J.; Inoue, K.; Nishigaki, H.; Tsuda, S.; Taniwaki, M.; Misawa, S.; Abe, T.: Assignment of the human myeloperoxidase gene (MPO) to bands q21.3-q23 of chromosome 17. Cytogenet. Cell Genet. 50:135-136, 1989.
1262. Johnson, K.; Gemperlein, I.; Hudson, S.; Shane, S.; Rovera, G.: Complete nucleotide sequence of the human myeloperoxidase gene. Nucleic Acids Res. 17: 7985-7986, 1989.
1263. Kizaki, M.; Miller, C. W.; Selsted, M. E.; Koeffler, H. P.: Myeloperoxidase (MPO) gene mutation in hereditary MPO deficiency. Blood 83: 1935-1940, 1994.
1264. Klebanoff, S. J.: Myeloperoxidase. Proc. Assoc. Am. Physicians 111:383-389, 1999.
1265. Kudoh, J.; Minoshima, S.; Hashinaka, K.; Nishio, C.; Yamada, M.; Shimizu, Y.; Shimizu, N.: Assignment of the myeloperoxidase gene MPO to human chromosome 17 using somatic cell hybrids and flow-sorted chromosomes. Jpn. J. Hum. Genet. 33: 315-324, 1988.
1266. Kudoh, J.; Minoshima, S.; Hashinaka, K.; Nishio, C.; Yamada, M.; Shimizu, Y.; Shimizu, N.: Assignment of the myeloperoxidase (MPO) gene to human chromosome 17. (Abstract) Cytogenet. Cell Genet. 46:641-642, 1987.
1267. Law, D. J.; Prasad, M. A.; King, S. E.; Spranger, K. D.; Lee, Y. H.; Fox, R. E.; Collins, E. E.; Gebuhr, T. C.; Miller, D. E.; Petty, E. M.: Localization of the human estrogen-responsive finger protein (EFP) gene (ZNF147) within a YAC contig containing the myeloperoxidase (MPO) gene. Genomics 28: 361-363, 1995.
1268. Antonarakis, S. E.: Personal Communication. Baltimore, Md. Mar. 25, 2002.
1269. McKemy, D. D.; Neuhausser, W. M.; Julius, D.: Identification of a cold receptor reveals a general role for TRP channels in thermosensation. Nature 416:52-58, 2002.
1270. Peier, A. M.; Moqrich, A.; Hergarden, A. C.; Reeve, A. J.; Andersson, D. A.; Story, G. M.; Earley, T. J.; Dragoni, I.; McIntyre, P.; Bevan, S.; Patapoutian, A.: A TRP channel that senses cold stimuli and menthol. Cell 108:705-715, 2002.
1271. Ashery-Padan, R.; Marquardt, T.; Zhou, X.; Gruss, P.: Pax6 activity in the lens primordium is required for lens formation and for correct placement of a single retina in the eye. Genes Dev. 14: 2701-2711, 2000.
1272. Azuma, N.; Yamaguchi, Y.; Handa, H.; Hayakawa, M.; Kanai, A.; Yamada, M.: Missense mutation in the alternative splice region of the PAX6 gene in eye anomalies. Am. J. Hum. Genet. 65: 656-663, 1999.
1273. Roginski, R. S.; Mohan Raj, B. K.; Finkernagel, S. W.; Sciorra, L. J.: Assignment of an ionotropic glutamate receptor-like gene (GRINL1A) to human chromosome 15q22.1 by in situ hybridization. Cytogenet. Cell Genet. 93: 143-144, 2001.
1274. Wydner, K. S.; Mohan Raj, B. K.; Sciorra, L. J.; Roginski, R. S.: The mouse orthologue of the human ionotropic glutamate receptor-like gene (GRINL1A) maps to mouse chromosome 9. Cytogenet. Cell Genet. 95:240-241, 2001.
1275. Nakamura, T.; Yamazaki, Y.; Saiki, Y.; Moriyama, M.; Largaespada, D. A.; Jenkins, N. A.; Copeland, N. G.: Evi9 encodes a novel zinc finger protein that physically interacts with BCL6, a known human B-cell proto-oncogene product. Molec. Cell Biol. 20: 3178-3186, 2000.
1276. Saiki, Y.; Yamazaki, Y.; Yoshida, M.; Katoh, O.; Nakamura, T.: Human EVI9, a homologue of the mouse myeloid leukemia gene, is expressed in the hematopoietic progenitors and down-regulated during myeloid differentiation of HL60 cells. Genomics 70: 387-391, 2000.
1277. Satterwhite, E.; Sonoki, T.; Willis, T. G.; Harder, L.; Nowak, R.; Arriola, E. L.; Liu, H.; Price, H. P.; Gesk, S.; Steinemann, D.; Schlegelberger, B.; Oscier, D. G.; Siebert, R.; Tucker, P. W.; Dyer, M. J. S.: The BCL11 gene family: involvement of BCL11A in lymphoid malignancies. Blood 98: 3413-3420, 2001.
1278. Le Beau, M. M.; Lemons, R. S.; Rosner, G. L.; Carrino, J. C.; Reid, M. S.; Chisholm, R. L.; Diaz, M. O.; Weil, S. C.: Chromosomal localization of the gene encoding myeloperoxidase. (Abstract) Cytogenet. Cell Genet. 46: 645, 1987.
1279. Richardson, J.; Cvekl, A.; Wistow, G.: Pax-6 is essential for lens-specific expression of zeta-crystallin. Proc. Nat. Acad. Sci. 92:4676-4680, 1995.
1280. Sander, M.; Neubuser, A.; Kalamaras, J.; Ee, H. C.; Martin, G. R.; German, M. S.: Genetic analysis reveals that PAX6 is required for normal transcription of pancreatic hormone genes and islet development. Genes Dev. 11: 1662-1673, 1997.
1281. Davis, A.; Cowell, J. K.: Mutations in the PAX6 gene in patients with hereditary aniridia. Hum. Molec. Genet. 2: 2093-2097, 1993.
1282. Gronskov, K.; Rosenberg, T.; Sand, A.; Brondum-Nielsen, K.: Mutational analysis of PAX6: 16 novel mutations including 5 missense mutations with a mild aniridia phenotype. Europ. J. Hum. Genet. 7: 274-286, 1999.
1283. Halder, G.; Callaerts, P.; Gehring, W. J.: Induction of ectopic eyes by targeted expression of the eyeless gene in *Drosophila*. Science 267:1788-1792, 1995.
1284. Hanson, I.; Brown, A.; van Heyningen, V.: A new PAX6 mutation in familial aniridia. J. Med. Genet. 32: 488-489, 1995.
1285. Hanson, I.; Van Heyningen, V.: Pax6: more than meets the eye. Trends Genet. 11: 268-272, 1995.
1286. Hanson, I. M.; Fletcher, J. M.; Jordon, T.; Brown, A.; Taylor, D.; Adams, R. J.; Punnett, H. H.; van Heyningen, V.: Mutations at the PAX6 locus are found in heterogeneous anterior segment malformations including Peters' anomaly. Nature Genet. 6: 168-173, 1994.
1287. Heins, N.; Malatesta, P.; Cecconi, F.; Nakafuku, M.; Tucker, K. L.; Hack, M. A.; Chapouton, P.; Barde, Y.-A.; Gotz, M.: Glial cells generate neurons: the role of the transcription factor Pax6. Nature Neurosci. 5: 308-315, 2002.
1288. Holmstrom, G. E.; Reardon, W. P.; Baraitser, M.; Elston, J. S.; Taylor, D. S.: Heterogeneity in dominant anterior segment malformations. Brit. J. Ophthal. 75: 591-597, 1991.

1289. Kioussi, C.; O'Connell, S.; St-Onge, L.; Treier, M.; Gleiberman, A. S.; Gruss, P.; Rosenfeld, M. G.: Pax6 is essential for establishing ventral-dorsal cell boundaries in pituitary gland development. Proc. Nat. Acad. Sci. 96: 14378-14382, 1999.

1290. Kleinjan, D. A.; Seawright, A.; Schedl, A.; Quinlan, R. A.; Danes, S.; van Heyningen, V.: Aniridia-associated translocations, DNase hypersensitivity, sequence comparison and transgenic analysis redefine the functional domain of PAX6. Hum. Molec. Genet. 10: 2049-2059, 2001.

1291. Lauderdale, J. D.; Wilensky, J. S.; Oliver, E. R.; Walton, D. S.; Glaser, T.: 3-prime deletions cause aniridia by preventing PAX6 gene expression. Proc. Nat. Acad. Sci. 97: 13755-13759, 2000.

1292. Marquardt, T.; Ashery-Padan, R.; Andrejewski, N.; Scardigli, R.; Guillemot, F.; Gruss, P.: Pax6 is required for the multipotent state of retinal progenitor cells. Cell 105: 43-55, 2001.

1293. Bentz, H.; Nathan, R. M.; Rosen, D. M.; Armstrong, R. M.; Thompson, A. Y.; Segarini, P. R.; Mathews, M. C.; Dasch, J. R.; Piez, K. A.; Seyedin, S. M.: Purification and characterization of a unique osteoinductive factor from bovine bone. J. Biol. Chem. 264: 20805-20810, 1989.

1294. Madisen, L.; Neubauer, M.; Plowman, G.; Rosen, D.; Segarini, P.; Dasch, J.; Thompson, A.; Ziman, J.; Bentz, H.; Purchio, A. F.: Molecular cloning of a novel bone-forming compound: osteoinductive factor. DNA Cell Biol. 9: 303-309, 1990.

1295. Chen, H.; Antonarakis, S. E.: The SH3D1A gene maps to human chromosome 21q22.1-q22.2. Cytogenet. Cell Genet. 78: 213-215, 1997.

1296. Pucharcos, C.; Estivill, X.; de la Luna, S.: Intersectin 2, anew multimodular protein involved in clathrin-mediated endocytosis. FEBS Lett. 478: 43-51, 2000.

1297. Gibbons, B.; Scott, D.; Hungerford, J. L.; Cheung, K. L.; Harrison, C.; Attard-Montalto, S.; Evans, M.; Birch, J. M.; Kingston, J. E.: Retinoblastoma in association with the chromosome breakage syndromes Fanconi's anaemia and Bloom's syndrome: clinical and cytogenetic findings. Clin. Genet. 47: 311-317, 1995.

1298. Girardet, A.; McPeek, M. S.; Leeflang, E. P.; Munier, F.; Arnheim, N.; Claustres, M.; Pellestor, F.: Meiotic segregation analysis of RB1 alleles in retinoblastoma pedigrees by use of single-sperm typing. Am. J. Hum. Genet. 66: 167-175, 2000.

1299. Godbout, R.; Dryja, T. P.; Squire, J.; Gallie, B. L.; Phillips, R. A.: Somatic inactivation of genes on chromosome 13 is a common event in retinoblastoma. Nature 304: 451-453, 1983.

1300. Goodrich, D. W.; Wang, N. P.; Qian, Y.-W.; Lee, E. Y.-H. P.; Lee, W.-H.: The retinoblastoma gene product regulates progression through the G1 phase of the cell cycle. Cell 67: 293-302, 1991.

1301. Grace, E.; Drennan, J.; Colver, D.; Gordon, R. R.: The 13q deletion syndrome. J. Med. Genet. 8: 351-357, 1971.

1302. Green, A. R.; Wyke, J. A.: Anti-oncogenes: a subset of regulatory genes involved in carcinogenesis? Lancet II: 475-477, 1985.

1303. Greger, V.; Kerst, S.; Messmer, E.; Hopping, W.; Passarge, E.; Horsthemke, B.: Application of linkage analysis to genetic counselling in families with hereditary retinoblastoma. J. Med. Genet. 25: 217-221, 1988.

1304. Greger, V.; Passarge, E.; Horsthemke, B.: Somatic mosaicism in a patient with bilateral retinoblastoma. Am. J. Hum. Genet. 46:1187-1193, 1990.

1305. Hagstrom, S. A.; Dryja, T. P.: Mitotic recombination map of 13cen-13q14 derived from an investigation of loss of heterozygosity in retinoblastomas. Proc. Nat. Acad. Sci. 96: 2952-2957, 1999.

1306. Hall, J. G.: Personal Communication. Vancouver, British Columbia, Canada May 29, 1993.

1307. Hanahan, D.; Weinberg, R. A.: The hallmarks of cancer. Cell 100:57-70, 2000.

1308. Harbour, J. W.: Molecular basis of low-penetrance retinoblastoma. Arch. Ophthal. 119: 1699-1704, 2001.

1309. Harbour, J. W.; Lai, S.-L.; Whang-Peng, J.; Gazdar, A. F.; Minna, J. D.; Kaye, F. J.: Abnormalities in structure and expression of the human retinoblastoma gene in SCLC. Science 241: 353-357, 1988.

1310. Hensel, C.; Hsieh, C.-L.; Lee, W.-H.; Pam-Lee, E.; Gazdar, A.; Sakaguchi, A. Y.; Naylor, S. L.: Allele loss and lack of expression of the RB-1 locus in small cell lung cancer. (Abstract) Am. J. Hum. Genet. 43: A25, 1988.

1311. Henson, J. W.; Schnitker, B. L.; Correa, K. M.; von Diemling, A.; Fassbender, F.; Xu, H.-J.; Benedict, W. F.; Yandell, D. W.; Louis, D. N.: The retinoblastoma gene is involved in malignant progression of astrocytomas. Ann. Neurol. 36: 714-721, 1994.

1312. Higgins, M. J.; Hansen, M. F.; Cavenee, W. K.; Lalande, M.: Molecular detection of chromosomal translocations that disrupt the putative retinoblastoma susceptibility locus. Molec. Cell. Biol. 9: 1-5, 1989.

1313. Hoegerman, S. F.: Chromosome 13 long arm interstitial deletion may result from maternal inverted insertion. Science 205: 1035-1036, 1979.

1314. Hogg, A.; Bia, B.; Onadim, Z.; Cowell, J. K.: Molecular mechanisms of oncogenic mutations in tumours from patients with bilateral and unilateral retinoblastoma. Proc. Nat. Acad. Sci. 90: 7351-7355, 1993.

1315. Honavar, S. G.; Shields, C. L.; Shields, J. A.; Demirci, H.; Naduvilath, T. J.: Intraocular surgery after treatment of retinoblastoma. Arch. Ophthal. 119: 1613-1621, 2001.

1316. Honavar, S. G.; Singh, A. D.; Shields, C. L.; Meadows, A. T.; Demirci, H.; Cater, J.; Shields, J. A.: Postenucleation adjuvant therapy in high-risk retinoblastoma. Arch. Ophthal. 120: 923-931, 2002.

1317. Hong, F. D.; Huang, H.-J. S.; To, H.; Young, L.-J. S.; Oro, A.; Bookstein, R.; Lee, E. Y.-H. P.; Lee, W.-H.: Structure of the human retinoblastoma gene. Proc. Nat. Acad. Sci. 86: 5502-5506, 1989.100. Horowitz, J. M.; Park, S.-H.; Bogenmann, E.; Cheng, J.-C.; Yandell, D. W.; Kaye, F. J.; Minna, J. D.; Dryja, T. P.; Weinberg, R. A.: Frequent inactivation of the retinoblastoma anti-oncogene is restricted to a subset of human tumor cells. Proc. Nat. Acad. Sci. 87: 2775-2779, 1990.101. Horowitz, J. M.; Park, S. H.; Yandell, D. W.; Weinberg, R. A.: Involvement of the retinoblastoma gene in the genesis of various human tumors: In: Kavenee, W.; Hastie, N.; Stanbridge, E.: Recessive oncogenes and Tumor Suppression: Current Communications in Molecular Biology. Cold Spring Harbor, N.Y.: Cold Spring Harbor Laboratory Press (pub.) 1989. Pp. 101-108.102. Horsthemke, B.; Greger, V.; Barnert, H. J.; Hopping, W.; Passarge, E.: Detection of submicroscopic deletions and a DNA polymorphism at the retinoblastoma locus. Hum. Genet. 76: 257-261, 1987.103. Horsthemke, B.; Greger, V.; Becher, R.; Passarge, E.: Mechanism of i(6p) formation in retinoblastoma tumor cells. Cancer Genet. Cytogenet. 37:95-102, 1989.104. Hsieh, J.-K.; Chan, F. S. G.; O'Connor, D. J.; Mittnacht, S.; Zhong, S.; Lu, X.: RB regulates the stability and the apoptotic function of p53 via MDM2. Molec. Cell 3: 181-193, 1999.105. Huang, H.-J. S.; Yee, J.-K.; Shew, J.-Y.; Chen, P.-L.; Bookstein, R.; Friedmann, T.; Lee, E. Y.-H. P.; Lee, W.-H.: Suppression of the-neoplastic phenotype by replacement of the RB gene in human cancer cells. Science 242: 1563-1566, 1988.106. Janson, M.; Nordenskjold, M.: A constitutional mutation within the retinoblastoma gene detected by PFGE. Clin. Genet. 45: 5-10, 1994.107. Jensen, R. D.; Miller, R. W.: Retinoblastoma: epidemiologic characteristics. New Eng. J. Med. 285: 307-311, 1971.108. Kimchi, A.; Wang, X.-F.; Weinberg, R. A.; Cheifetz, S.; Massague, J.: Absence of TGF-beta receptors and growth inhibitory responses in retinoblastoma cells. Science 240: 196-199, 1988.109. Kitchin, F. D.; Ellsworth, R. M.: Pleiotropic effects of the-gene for retinoblastoma. J. Med. Genet. 11: 244-246, 1974.110. Kivela, T.: Trilateral retinoblastoma: a meta-analysis of hereditary retinoblastoma associated with primary ectopic intracranial retinoblastoma. J. Clin. Oncol. 17: 1829-1837, 1999.111. Kivela, T.; Asko-Seljavaara, S.; Pihkala, U.; Hovi, L.; Heikkonen, J.: Sebaceous carcinoma of the eyelid associated with retinoblastoma. Ophthalmology 108:1124-1128, 2001.112. Klutz, M.; Brockmann, D.; Lohmann, D. R.: A parent-of-origin effect in two families with retinoblastoma is associated with a distinct splice mutation in the RB1 gene. Am. J. Hum. Genet. 71: 174-179, 2002.113. Knight, L. A.; Gardner, H. A.; Gallie, B. L.: Familial retinoblastoma: segregation of chromosome 13 in four families. Am. J. Hum. Genet. 32:194-201, 1980.114. Knudson, A. G.: Hereditary cancer, oncogenes and antioncogenes. Cancer Res. 45: 1437-1443, 1985.115. Knudson, A. G., Jr.: Mutation and cancer: statistical study of retinoblastoma. Proc. Nat. Acad. Sci. 68: 820-823, 1971.116. Knudson, A. G., Jr.: Genetics of human cancer. Annu. Rev. Genet. 20:231-251, 1986.117. Knudson, A. G., Jr.; Hethcote, H. W.; Brown, B. W.: Mutation and childhood cancer: a probabilistic model for the incidence of retinoblastoma. Proc. Nat. Acad. Sci. 72: 5116-5120, 1975.118. Knudson, A. G., Jr.; Meadows, A. T.; Nichols, W. W.; Hill, R.: Chromosomal deletion and retinoblastoma. New Eng. J. Med. 295:1120-1123, 1976.119. Laquis, S. J.; Rodriguez-Galindo, C.; Wilson, M. W.; Fleming, J. C.; Haik, B. G.: Retinoblastoma in a patient with an X; 13 translocation and facial abnormalities consistent with 13q-syndrome. Am. J. Ophthal. 133:285-287, 2002.120. Lee, W.-H.; Bookstein, R.; Hong, F.; Young, L.-J.; Shew, J.-Y.; Lee, E. Y.-H. P.: Human retinoblastoma susceptibility gene: cloning, identification, and sequence. Science 235: 1394-1399, 1987.121. Lee, W.-H.; Shew, J.-Y.; Hong, F. D.; Sery, T. W.; Donoso, L. A.; Young, L.-J.; Bookstein, R.; Lee, E. Y.-H. P.: The retinoblastoma susceptibility gene encodes a nuclear phosphoprotein associated with DNA binding activity. Nature 329: 642-645, 1987.122. Lele, K. P.; Penrose, L. S.; Stallard, H. B.: Chromosome deletion in a case of retinoblastoma. Ann. Hum. Genet. 27: 171-174, 1963.123. Lemieux, N.; Messier, P. E.; Jacob, J. L.; Milot, J.; Richer, C. L.: Precise cytogenetic localization of the Rb locus at subband 13q14.11 by ultrastructural detection after immunochemical chromosome banding. (Abstract) Am. J. Hum. Genet. 45 (suppl.): A27, 1989.124. Liu, Z.; Song, Y.; Bia, B.; Cowell, J. K.: Germline mutations in the RB1 gene in patients with hereditary retinoblastoma. Genes Chromosomes Cancer 14: 277-284, 1995.125. Lohmann, D. R.; Brandt, B.; Hopping, W.; Passarge, E.; Horsthemke, B.: Spectrum of small length germline mutations in the RB1 gene. Hum. Molec. Genet. 3: 2187-2193, 1994.126. Lohmann, D. R.; Brandt, B.; Hopping, W.; Passarge, E.; Horsthemke, B.: The spectrum of RB1 germ-line mutations in hereditary retinoblastoma. Am. J. Hum. Genet. 58: 940-949, 1996.127. Lohmann, D. R.; Gerick, M.; Brandt, B.; Oelschlager, U.; Lorenz, B.; Passarge, E.; Horsthemke, B.: Constitutional RB1-gene mutations in patients with isolated unilateral retinoblastoma. Am. J. Hum. Genet. 61: 282-294, 1997.128. Lomazzi, M.; Moroni, M. C.; Jensen, M. R.; Frittoli, E.; Helin, K.: Suppression of the p53- or pRB-mediated G1 checkpoint is required for E2F-induced S-phase entry. Nature Genet 31: 190-194, 2002.129. Lueder, G. T.; Judisch, G. F.; Wen, B.-C.: Heritable retinoblastoma and pinealoma. Arch. Ophthal. 109: 1707-1709, 1991.130. Luo, R. X.; Postigo, A. A.; Dean, D. C.: Rb interacts with histone deacetylase to repress transcription. Cell 92: 463-473, 1998.131. Maat-Kievit, J. A.; Oepkes, D.; Hartwig, N. G.; Vermeij-Keers, C.; van Kamp, I. L.; van de Kamp, J. J. P.: A large retinoblastoma detected in a fetus at 21 weeks of gestation. Prenatal Diag. 13:377-384, 1993.132. MacKay, C. J.; Abramson, D. H.; Ellsworth, R. M.: Metastatic patterns of retinoblastoma. Arch. Ophthal. 102: 391-396, 1984.133. Macklin, M. T.: A study of retinoblastoma in Ohio. Am. J. Hum. Genet. 12: 1-43, 1960.134. Macklin, M. T.: Inheritance of retinoblastoma in Ohio. Arch. Ophthal. 62: 842-851, 1959.135. Manchester, P. T., Jr.: Retinoblastoma among offspring of adult survivors. Arch. Ophthal. 65: 546-549, 1961.136. Mancini, D.; Singh, S.; Ainsworth, P.; Rodenhiser, D.: Constitutively methylated CpG dinucleotides as mutation hot spots in the retinoblastoma gene (RB1). Am. J. Hum. Genet. 61: 80-87, 1997.137. Mancini, M. A.; Shan, B.; Nickerson, J. A.; Penman, S.; Lee, W.-H.: The retinoblastoma gene product is a cell cycle-dependent, nuclear matrix-associated protein. Proc. Nat. Acad. Sci. 91: 418-422, 1994.138. Marino, S.; Vooijs, M.; van der Gulden, H.; Jonker, J.; Berns, A.: Induction of medulloblastomas in p53-null mutant mice by somatic inactivation of Rb in the external granular layer cells of the cerebellum. Genes Dev. 14: 994-1004, 2000.139. Matsunaga, E.: Recurrence risks to relatives of patients with retinoblastoma. Jpn. J. Ophthal. 22: 313-319, 1978.140. Matsunaga, E.: Almost synchronous appearance of bilateral retinoblastomas. (Letter) Am. J. Med. Genet. 11: 485-487, 1982.141. Matsunaga, E.: Retinoblastoma: mutational mosaicism or host resistance? Am. J. Med. Genet. 8: 375-387, 1981.142. Matsunaga, E.: Hereditary retinoblastoma: host resistance and second primary tumors. J. Nat. Cancer Inst. 65: 47-51, 1980.143. Matsunaga, E.: Hereditary retinoblastoma: delayed mutation or host resistance? Am. J. Hum. Genet. 30: 406-425, 1978.144. Matsunaga, E.; Minoda, K.; Sasaki, M. S.: Parental age and seasonal variation in the births of children with sporadic retinoblastoma: a mutation-epidemiologic study. Hum. Genet. 84: 155-158, 1990.145. Michalova, K.; Kloucek, F.; Musilova, J.: Deletion of 13q in two patients with retinoblastoma, one probably due to 13q-mosaicism in the mother. Hum. Genet. 61: 264-266, 1982.146. Moll, A. C.; Imhof, S. M.; Schouten-Van Meeteren, A. Y. N.; Kuik, D. J.; Hofman, P.; Boers, M.: Second primary tumors in hereditary retinoblastoma: a register-based study, 1945-1997. Is there an age effect on radiation-related risk? Ophthalmology 108: 1109-1114, 2001.147. Motegi, T.: Lymphocyte chromosome survey in 42 patients with retinoblastoma: effort to detect 13q14 deletion mosaicism. Hum. Genet. 58:168-173, 1981.148. Motegi, T.: High rate of detection of 13q14 deletion mosaicism among retinoblastoma patients (using more extensive methods). Hum. Genet. 61: 95-97, 1982.149. Motegi, T.; Kaga, M.; Yanagawa, Y.; Kadowaki, H.; Watanabe, K.; Inoue, A.; Komatsu, M.; Minoda, K.: A recognizable pattern of the midface of retinoblastoma patients with interstitial deletion of 13q. Hum. Genet. 64:

150. Motegi, T.; Komatsu, M.; Minoda, K.: Is the interstitial deletion of 13q in retinoblastoma patients not transmissible? (Letter) Hum. Genet. 64: 205, 1983.
151. Motegi, T.; Komatsu, M.; Nakazato, Y.; Ohuchi, M.; Minoda, K.: Retinoblastoma in a boy with a de novo mutation of a 13/18 translocation: the assumption that the retinoblastoma locus is at 13q141, particularly at the distal portion of it. Hum. Genet. 60: 193-195, 1982.
152. Munier, F.; Spence, M. A.; Pescia, G.; Balmer, A.; Gailloud, C.; Thonney, F.; van Melle, G.; Rutz, H. P.: Paternal selection favoring mutant alleles of the retinoblastoma susceptibility gene. Hum. Genet. 89:508-512, 1992.
153. Munier, F. L.; Wang, M. X.; Spence, M. A.; Thonney, F.; Balmer, A.; Pescia, G.; Donoso, L. A.; Murphree, A. L.: Pseudo low penetrance in retinoblastoma: fortuitous familial aggregation of sporadic cases caused by independently derived mutations in two large pedigrees. Arch. Ophthal. 111: 1507-1511, 1993.
154. Murphree, A. L.; Benedict, W. F.: Retinoblastoma: clues to human oncogenesis. Science 223: 1028-1033, 1984.
155. Naumova, A.; Hansen, M.; Strong, L.; Jones, P. A.; Hadjistilianou, D.; Mastrangelo, D.; Griegel, S.; Rajewsky, M. F.; Shields, J.; Donoso, L.; Wang, M.; Sapienza, C.: Concordance between parental origin of chromosome 13q loss and chromosome 6p duplication in sporadic retinoblastoma. Am. J. Hum. Genet. 54: 274-281, 1994.
156. Naumova, A.; Sapienza, C.: The genetics of retinoblastoma, revisited. Am. J. Hum. Genet. 54: 264-273, 1994.
157. Nevins, J. R.: The Rb/E2F pathway and cancer. Hum. Molec. Genet. 10:699-703, 2001.
158. Nichols, W. W.; Miller, R. C.; Sobel, M.; Hoffman, E.; Sparkes, R. S.; Mohandas, T.; Veomett, I.; Davis, J. R.: Further observations on a 13qXp translocation associated with retinoblastoma. Am. J. Ophthal. 89:621-627, 1980.
159. Nielsen, S. J.; Schneider, R.; Bauer, U.-M.; Bannister, A. J.; Morrison, A.; O'Carroll, D.; Firestein, R.; Cleary, M.; Jenuwein, T.; Herrera, R. E.; Kouzarides, T.: Rb targets histone H3 methylation and HP1 to promoters. Nature 412: 561-565, 2001.
160. Nirankari, M. S.; Gulati, G. C.; Chaddah, M. R.: Retinoblastoma: genetics and report of a family. Am. J. Ophthal. 53: 523-532, 1962.
161. Noorani, H. Z.; Khan, H. N.; Gallie, B. L.; Detsky, A. S.: Cost comparison of molecular versus conventional screening of relatives at risk for retinoblastoma. Am. J. Hum. Genet. 59: 301-307, 1996.
162. Nussbaum, R.; Puck, J.: Recurrence risks for retinoblastoma: a model for autosomal dominant disorders with complex inheritance. J. Pediat. Ophthal. 13: 89-98, 1976.
163. Onadim, Z.; Hogg, A.; Baird, P. N.; Cowell, J. K.: Oncogenic point mutations in exon 20 of the RB1 gene in families showing incomplete penetrance and mild expression of the retinoblastoma phenotype. Proc. Nat. Acad. Sci. 89: 6177-6181, 1992.
164. Onadim, Z.; Woolford, A. J.; Kingston, J. E.; Hungerford, J. L.: The RB1 gene mutation in a child with ectopic intracranial retinoblastoma. Brit. J. Cancer 76: 1405-1409, 1997.
165. Ono, T.; Yoshida, M. C.: Chromosomal assignment of retinoblastomal gene (RB1) to mouse 14D3 and rat 15q12 by fluorescence in situ hybridization. Jpn. J. Genet. 68: 617-621, 1993.
166. Orye, E.; Benoit, Y.; Coppieters, R.; Jeannin, P.; Vercruysse, C.; Delaey, J.; Delbeke, M.-J.: A case of retinoblastoma, associated with histiocytosis-X and mosaicism of a deleted D-group chromosome (13q-14-q31). Clin. Genet. 22: 37-39, 1982.
167. Orye, E.; Delbeke, M. J.; Vandenabeele, B.: Retinoblastoma and long arm deletion of chromosome 13. Attempts to define the deleted segment. Clin. Genet. 5: 457-464, 1974.
168. Orye, E.; Delbeke, M. J.; Vandenabeele, B.: Retinoblastoma and D-chromosome deletions. (Letter) Lancet II: 1376, 1971.
169. Otterson, G. A.; Modi, S.; Nguyen, K.; Coxon, A. B.; Kaye, F. J.: Temperature-sensitive RB mutations linked to incomplete penetrance of familial retinoblastoma in 12 families. Am. J. Hum. Genet. 65:1040-1046, 1999.
170. Otterson, G. W.; Chen, W.; Coxon, A. B.; Khleif, S. N.; Kaye, F. J.: Incomplete penetrance of familial retinoblastoma linked to germ-line mutations that result in partial loss of RB function. Proc. Nat. Acad. Sci. 94: 12036-12040, 1997.
171. Pendergrass, T. W.; Davis, S.: Incidence of retinoblastoma in the United States. Arch. Ophthal. 98: 1204-1210, 1980.
172. Pennaneach, V.; Salles-Passador, I.; Munshi, A.; Brickner, H.; Regazzoni, K.; Dick, F.; Dyson, N.; Chen, T.-T.; Wang, J. Y. J.; Fotedar, R.; Fotedar, A.: The large subunit of replication factor C promotes cell survival after DNA damage in an LxCxE motif- and Rb-dependent manner. Molec. Cell 7: 715-727, 2001.
173. Riccardi, V. M.; Hittner, H. M.; Francke, U.; Pippin, S.; Holmquist, G. P.; Kretzer, F. L.; Ferrell, R.: Partial triplication and deletion of 13q: study of a family presenting with bilateral retinoblastomas. Clin. Genet. 15: 332-345, 1979.
174. Rivera, H.; Turleau, C.; de Grouchy, J.; Junien, C.; Despoisse, S.; Zucker, J.-M.: Retinoblastoma-del(13q14): report of two patients, one with a trisomic sib due to maternal insertion; gene dosage effect for esterase D. Hum. Genet. 59: 211-214, 1981.
175. Sakai, T.; Ohtani, N.; McGee, T. L.; Robbins, P. D.; Dryja, T. P.: Oncogenic germ-line mutations in Sp1 and ATF sites in the human retinoblastoma gene. Nature 353: 83-86, 1991.
176. Sakai, T.; Ohtani, N.; McGee, T. L.; Robbins, P. D.; Dryja, T. P.: Oncogenic germ-line mutations in Sp1 and ATF sites in the human retinoblastoma gene. Nature 353: 83-86, 1991.
177. Sakai, T.; Toguchida, J.; Ohtani, N.; Yandell, D. W.; Rapaport, J. M.; Dryja, T. P.: Allele-specific hypermethylation of the retinoblastoma tumor-suppressor gene. Am. J. Hum. Genet. 48: 880-888, 1991.
178. Schappert-Kimmijser, J.; Hemmes, G. D.; Nijland, R.: The heredity of retinoblastoma. Ophthalmologica 151: 197-213, 1966.
179. Scheffer, H.; te Meerman, G. J.; Kruize, Y. C. M.; van den Berg, A. H. M.; Penninga, D. P.; Tan, K. E. W. P.; der Kinderen, D. J.; Buys, C. H. C. M.: Linkage analysis of families with hereditary retinoblastoma: nonpenetrance of mutation, revealed by combined use of markers within and flanking the RB1 gene. Am. J. Hum. Genet. 45: 252-260, 1989.
180. Schimke, R. N.; Lowman, J.; Cowan, G.: Retinoblastoma and osteogenic-sarcoma in sibs. Cancer 34: 2077-2079, 1974.
181. Schubert, E. L.; Strong, L. C.; Hansen, M. F.: A splicing mutation in RB1 in low penetrance retinoblastoma. Hum. Genet. 100: 557-563, 1997.
182. Shields, C. L.; Honavar, S.; Shields, J. A.; Demirci, H.; Meadows, A. T.: Vitrectomy in eyes with unsuspected retinoblastoma. Ophthalmology 107:2250-2255, 2000.
183. Shiio, Y.; Yamamoto, T.; Yamaguchi, N.: Negative regulation of Rb expression by the p53 gene product. Proc. Nat. Acad. Sci. 89:5206-5210, 1992.
184. Shroeder, W. T.; Chao, L.-Y.; Dao, D. D.; Strong, L. C.; Pathak, S.; Riccardi, V.; Lewis, W. H.; Saunders, G. F.: Nonrandom loss of maternal chromosome 11 alleles in Wilms tumors. Am. J. Hum. Genet. 40:413-420, 1987.
185. Sippel, K. C.; Fraioli, R. E.; Smith, G. D.; Schalkoff, M. E.; Sutherland, J.; Gallie, B. L.; Dryja, T. P.: Frequency of somatic and germ-line mosaicism in retinoblastoma: implications for genetic counseling. Am. J. Hum. Genet. 62: 610-619, 1998.
186. Smith, S. M.; Sorsby, A.: Retinoblastoma: some genetic aspects. Ann. Hum. Genet. 23: 50-58, 1958.
187. Sparkes, R. S.: The genetics of retinoblastoma. Biochim. Biophys. Acta 780: 95-118, 1985.
188. Sparkes, R. S.; Muller, H.; Klisak, I.; Abram, J. A.: Retinoblastoma with 13q; chromosomal deletion associated with maternal paracentric inversion of 13q. Science 203: 1027-1029, 1979. 189. Sparkes, R. S.; Murphree, A. L.; Lingua, R. W.; Sparkes, M. C.; Field, L. L.; Funderburk, S. J.; Benedict, W. F.: Gene for hereditary retinoblastoma assigned to human chromosome 13 by linkage to esterase D. Science 219: 971-973, 1983. 190. Sparkes, R. S.; Sparkes, M. C.; Wilson, M. G.; Towner, J. W.; Benedict, W.; Murphree, A. L.; Yunis, J. J.: Regional assignment of genes for human esterase D and retinoblastoma to chromosome band 13q14. Science 208: 1042-1044, 1980. 191. Sparkes, R. S.; Sparkes, M. C.; Wilson, M. G.; Towner, J. W.; Benedict, W.; Murphree, A. L.; Yunis, J. J.: Regional assignment of genes for human esterase D and retinoblastoma to chromosome band 13q14. (Abstract) Cytogenet. Cell Genet. 25: 209, 1979. 192. Squire, J.; Gallie, B. L.; Phillips, R. A.: A detailed analysis of chromosomal changes in heritable and non-heritable retinoblastoma. Hum. Genet. 70: 291-301, 1985. 193. Squire, J.; Phillips, R. A.; Boyce, S.; Godbout, R.; Rogers, B.; Gallie, B. L.: Isochromosome 6p, a unique chromosomal abnormality in retinoblastoma: verification by standard staining techniques, new densitometric methods, and somatic cell hybridization. Hum. Genet. 66:46-53, 1984. 194. Stallard, H. B.: The conservation treatment of retinoblastoma. Trans. Ophthal. Soc. 82: 473, 1962. 195. Stone, J. C.; Crosby, J. L.; Kozak, C. A.; Schievella, A. R.; Bernards, R.; Nadeau, J. H.: The murine retinoblastoma homolog maps to chromosome 14 near Es-10. Genomics 5: 70-75, 1989. 196. Strong, L. C.; Riccardi, V. M.; Ferrell, R. E.; Sparkes, R. S.: Familial retinoblastoma and chromosome 13 deletion transmitted via an insertional translocation. Science 213: 1501-1503, 1981. 197. Taylor, A. I.: Dq-, Dr and retinoblastoma. Humangenetik 10:209-217, 1970. 198. Thomas, D. M.; Carty, S. A.; Piscopo, D. M.; Lee, J.-S.; Wang, W.-F.; Forrester, W. C.; Hinds, P. W.: The retinoblastoma protein acts as a transcriptional coactivator required for osteogenic differentiation. Molec. Cell 8: 303-316, 2001. 199. Toguchida, J.; Ishizaki, K.; Sasaki, M. S.; Nakamura, Y.; Ikenaga, M.; Kato, M.; Sugimot, M.; Kotoura, Y.; Yamamuro, T.: Preferential mutation of paternally derived RB gene as the initial event in sporadic osteosarcoma. Nature 338: 156-158, 1989. 200. Toguchida, J.; McGee, T. L.; Paterson, J. C.; Eagle, J. R.; Tucker, S.; Yandell, D. W.; Dryja, T. P.: Complete genomic sequence of the human retinoblastoma susceptibility gene. Genomics 17: 535-543, 1993. 201. Turleau, C.; de Grouchy, J.; Chavin-Colin, F.; Despoisses, S.; Leblanc, A.: Two cases of del (13q)-retinoblastoma and two cases of partial trisomy due to a familial insertion. Ann. Genet. 26: 158-160, 1983. 202. Turleau, C.; de Grouchy, J.; Chavin-Colin, F.; Junien, C.; Seger, J.; Schlienger, P.; Leblanc, A.; Haye, C.: Cytogenetic forms of retinoblastoma: their incidence in a survey of 66 patients. Cancer Genet. Cytogenet. 16:321-334, 1985. 203. Verma, R. S.; Ramesh, K. H.; Samonte, R. V.; Conte, R. A.: Mapping the homolog of the human Rb1 gene to chromosome 14 of higher primates. Mammalian Genome 7: 591-592, 1996. 204. Vogel, F.: Genetics of retinoblastoma. Modern Trends in Ophthalmology. (pub.) 1968. 205. Vogel, F.: Genetics of retinoblastoma. In: Genetic Counseling. Heidelberg University, Science Library. Trans. by Sabine Kurth. New York: Springer Verlag (pub.) 1969. 206. Vogel, F.: The genetics of retinoblastoma. Hum. Genet. 52:1-54, 1979. 207. Warburg, M.: Retinoblastoma. In: Goldberg, M. F.: Genetic and Metabolic Eye Disease. Boston: Little, Brown and Co. (pub.) 1974. Pp. 447-461. 208. Weichselbaum, R. R.; Beckett, M.; Diamond, A.: Some retinoblastomas, osteosarcomas, and soft tissue sarcomas may share a common etiology. Proc. Nat. Acad. Sci. 85: 2106-2109, 1988. 209. Weichselbaum, R. R.; Nove, J.; Little, J. B.: Fibroblasts from a D-deletion type retinoblastoma patient are abnormally x-ray sensitive. Nature 266:726-727, 1977. 210. Weinberg, R. A.: The retinoblastoma protein and cell cycle control. Cell 81:323-330, 1995. 211. Whyte, P.; Buchkovich, K. J.; Horowitz, J. M.; Friend, S. H.; Raybuck, M.; Weinberg, R. A.; Harlow, E.: Association between an oncogene and an anti-oncogene: the adenovirus E1A proteins bind to the retinoblastoma gene product. Nature 334: 124-129, 1988. 212. Wiggs, J.; Nordenskjold, M.; Yandell, D.; Rapaport, J.; Grondin, V.; Janson, M.; Werelius, B.; Petersen, R.; Craft, A.; Riedel, K.; Liberfarb, R.; Walton, D.; Wilson, W.; Dryja, T. P.: Prediction of the risk of hereditary retinoblastoma, using DNA polymorphisms within the retinoblastoma gene. New Eng. J. Med. 318: 151-157, 1988. 213. Wilson, M. G.; Ebbin, A. J.; Towner, J. W.; Spencer, W. H.: Chromosomal anomalies in patients with retinoblastoma. Clin. Genet. 12:1-8, 1977. 214. Wilson, M. G.; Melnyk, J.; Towner, J. W. J.: Retinoblastoma and deletion D(14) syndrome. J. Med. Genet. 6: 322-327, 1969. 215. Wilson, M. G.; Towner, J. W.; Fujimoto, A.: Retinoblastoma and D-chromosome deletions. Am. J. Hum. Genet. 25: 57-61, 1973. 216. Windle, J. J.; Albert, D. M.; O'Brien, J. M.; Marcus, D. M.; Disteche, C. M.; Bernards, R.; Mellon, P. L.: Retinoblastoma in transgenic mice. Nature 343: 665-669, 1990. 217. Yandell, D. W.; Campbell, T. A.; Dayton, S. H.; Petersen, R.; Walton, D.; Little, J. B.; McConkie-Rosell, A.; Buckley, E.; Dryja, T.: Oncogenic point mutations in the human retinoblastoma gene: their application to genetic counseling. New Eng. J. Med. 321: 1689-1695, 1989. 218. Yokota, J.; Akiyama, T.; Fung, Y.-K. T.; Benedict, W. F.; Namba, Y.; Hanaoka, M.; Wada, M.; Terasaki, T.; Shimosato, Y.; Sugimura, T.; Terada, M.: Altered expression of the retinoblastoma (RB) gene in small-cell carcinoma of the lung. Oncogene 3: 471-475, 1988. 219. Zeschnigk, M.; Lohmann, D.; Horsthemke, B.: A PCR test for the detection of hypermethylated alleles at the retinoblastoma locus. J. Med. Genet. 36: 793-794, 1999. 220. Zhang, H. S.; Postigo, A. A.; Dean, D. C.: Active transcriptional repression by the Rb-E2F complex mediates G1 arrest triggered by p16(INK4a), TGF-beta, and contact inhibition. Cell 97: 53-61, 1999. 221. Zhu, X.; Dunn, J. M.; Phillips, R. A.; Goddard, A. D.; Paton, K. E.; Becker, A.; Gallie, B. L.: Preferential germline mutation of the paternal allele in retinoblastoma. Nature 340: 312-313, 1989.

1318. Baens, M.; Aerssens, J.; Van Zand, K.; Van den Berghe, H.; Marynen, P.: Isolation and regional assignment of human chromosome 12p cDNAs. Genomics 29:44-52, 1995.

1319. Benbrook, D.; Lernhardt, E.; Pfahl, M.: A new retinoic acid receptor identified from a hepatocellular carcinoma. (Letter) Nature 333:669-672, 1988.

1320. Brand, N.; Petkovich, M.; Krust, A.; Chambon, P.; de The, H.; Marchio, A.; Tiollais, P.; Dejean, A.: Identification of a second human retinoic acid receptor. (Letter) Nature 332: 850-853, 1988.

1321. Dejean, A.; Bougueleret, L.; Grzeschik, K.-H.; Tiollais, P.: Hepatitis B virus DNA integration in a sequence homologous to v-erb-A and steroid receptor genes in a hepatocellular carcinoma. Nature 322: 70-72, 1986.

1322. de The, H.; del Mar Vivanco-Ruiz, M.; Tiollais, P.; Stunnenberg, H.; Dejean, A.: Identification of a retinoic acid responsive element in the retinoic acid receptor beta gene. Nature 343: 177-180, 1990.

1323. Aruffo, A.; Seed, B.: Molecular cloning of a CD28 cDNA by a high-efficiency COS cell expression system. Proc. Nat. Acad. Sci. 84: 8573-8577, 1987.

1324. Lafage-Pochitaloff, M.; Costello, R.; Couez, D.; Simonetti, J.; Mannoni, P.; Mawas, C.; Olive, D.: Human CD28 and CTLA-4 Ig superfamily genes are located on chromosome 2 at bands q33-q34. Immunogenetics 31:198-201, 1990.

1325. Lee, K. P.; Taylor, C.; Petryniak, B.; Turka, L. A.; June, C. H.; Thompson, C. B.: The genomic organization of the CD28 gene: implications for the regulation of CD28 mRNA expression and heterogeneity. J. Immun. 145: 344-352, 1990.

1326. Lesslauer, W.; Gmunder, H.; Bohlen, P.: Purification and N-terminal amino acid sequence of the human T90/44 (CD28) antigen. Immunogenetics 27:388-391, 1988.

1327. Okkenhaug, K.; Wu, L.; Garza, K. M.; La Rose, J.; Khoo, W.; Odermatt, B.; Mak, T. W.; Ohashi, P. S.; Rottapel, R.: A point mutation in CD28 distinguishes proliferative signals from survival signals. Nature Immun. 2: 325-332, 2001.

1328. Jourdan-Le Saux, C.; Tomsche, A.; Ujfalusi, A.; Jia, L.; Csiszar, K.: Central nervous system, uterus, heart, and leukocyte expression of the LOXL3 gene, encoding a novel lysyl oxidase-like protein. Genomics 74:211-218, 2001.

1329. Maki, J. M.; Kivirikko, K. I.: Cloning and characterization of a fourth human lysyl oxidase isoenzyme. Biochem. J. 355: 381-387, 2001.

1330. Riewald, M.; Petrovan, R. J.; Donner, A.; Mueller, B. M.; Ruf, W.: Activation of endothelial cell protease activated receptor 1 by the protein C pathway. Science 296: 1880-1882, 2002.

1331. de The, H.; Marchio, A.; Tiollais, P.; Dejean, A.: A novel steroid thyroid hormone receptor-related gene inappropriately expressed inhuman hepatocellular carcinoma. Nature 330: 667-670, 1987.

1332. Kreczel, W.; Ghyselinck, N.; Samad, T. A.; Dupe, V.; Kastner, P.; Borrelli, E.; Chambon, P.: Impaired locomotion and dopamine signaling in retinoid receptor mutant mice. Science 279: 863-867, 1998.

1333. Lotan, R.; Xu, X.-C.; Lippman, S. M.; Ro, J. Y.; Lee, J. S.; Lee, J. J.; Hong, W. K.: Suppression of retinoic acid receptor-beta in premalignant oral lesions and its upregulation by isotretinoin. New Eng. J. Med. 332: 1405-1410, 1995.

1334. Mattei, M.-G.; de The, H.; Mattei, J.-F.; Marchio, A.; Tiollais, P.; Dejean, A.: Assignment of the human hap retinoic acid receptor RAR-beta gene to the p24 band of chromosome 3. Hum. Genet. 80: 189-190, 1988.

1335. Nadeau, J. H.; Compton, J. G.; Giguere, V.; Rossant, J.; Varmuza, S.: Close linkage of retinoic acid receptor genes with homeobox- and keratin-encoding genes on paralogous segments of mouse chromosomes 11 and 15. Mammalian Genome 3: 202-208, 1992.

1336. Samad, A.; Kreczel, W.; Chambon, P.; Borrelli, E.: Regulation of dopaminergic pathways by retinoids: activation of the D2 receptor promoter by members of the retinoic acid receptor-retinoid X receptor family. Proc. Nat. Acad. Sci. 94: 14349-14354, 1997.

1337. Sakaguchi, A. Y.; Zabel, B. U.; Grzeschik, K. H.; Law, M. L.; Ellis, R. W.; Skolnick, E. M.; Naylor, S. L.: Regional localization of two human cellular Kirsten ras genes on chromosomes 6 and 12. Molec. Cell. Biol. 4: 989-993, 1984.

1338. Kas, K.; Roijer, E.; Voz, M.; Meyen, E.; Stenman, G.; Van de Ven, W. J. M.: A 2-Mb YAC contig and physical map covering the chromosome 8q12 breakpoint cluster region in pleomorphic adenomas of the salivary glands. Genomics 43: 349-358, 1997.

1339. Kas, K.; Voz, M. L.; Roijer, E.; Astrom, A.-K.; Meyen, E.; Stenman, G.; Van de Ven, W. J. M.: Promoter swapping between the genes for a novel zinc finger protein and beta-catenin in pleiomorphic adenomas with t(3;8)(p211;q12) translocations. Nature Genet. 15: 170-174, 1997.

1340. Szabo, G.; Dallmann, G.; Muller, G.; Patthy, L.; Soller, M.; Varga, L.: A deletion in the myostatin gene causes the compact (Cmpt) hypermuscular mutation in mice. Mammalian Genome 9: 671-672, 1998.

1341. Zimmers, T. A.; Davies, M. V.; Koniaris, L. G.; Haynes, P.; Esquela, A. F.; Tomkinson, K. N.; McPherron, A. C.; Wolfman, N. M.; Lee, S.-J.: Induction of cachexia in mice by systemically administered myostatin. Science 296: 1486-1488, 2002.

1342. Kimura, K.; Ito, M.; Amano, M.; Chihara, K.; Fukata, Y.; Nakafuku, M.; Yamamori, B.; Feng, J.; Nakano, T.; Okawa, K.; Iwamatsu, A.; Kaibuchi, K.: Regulation of myosin phosphatase by Rho and Rho-associated kinase (Rho-kinase). Science 273: 245-248, 1996.

1343. Takahashi, N.; Ito, M.; Tanaka, J.; Nakano, T.; Kaibuchi, K.; Odai, H.; Takemura, K.: Localization of the gene coding for myosin phosphatase, target subunit 1 (MYPT1) to human chromosome 12q15-q21. Genomics 44:150-152, 1997.

1344. D'Esposito, M.; Strazzullo, M.; Cuccurese, M.; Spalluto, C.; Rocchi, M.; D'Urso, M.; Ciccodicola, A.: Identification and assignment of the human transient receptor potential channel 6 gene TRPC6 to chromosome 11q21-q22. Cytogenet. Cell Genet. 83: 46-47, 1998.

1345. Hofmann, T.; Obukhov, A. G.; Schaefer, M.; Harteneck, C.; Gudermann, T.; Schultz, G.: Direct activation of human TRPC6 and TRPC3 channels by diacylglycerol. Nature 397: 259-263, 1999.

1346. Tasheva, E. S.; Pettenati, M.; Von Kap-Her, C.; Conrad, G. W.: Assignment of mimecan gene (OGN) to human chromosome band 9q22 by in situ hybridization. Cytogenet. Cell Genet. 88: 326-327, 2000.

1347. Pucharcos, C.; Fuentes, J.-J.; Casas, C.; de la Luna, S.; Alcantara, S.; Arbones, M. L.; Soriano, E.; Estivill, X.; Prichard, M.: Alu-splice cloning of human intersect in (ITSN), a putative multivalent binding protein expressed in proliferating and differentiating neurons and overexpressed in Down syndrome. Europ. J. Hum. Genet. 7: 704-712, 1999.

1348. Katz, P.; Whalen, G.; Kehrl, J. H.: Differential expression of a novel protein kinase in human B lymphocytes: preferential localization in the germinal center. J. Biol. Chem. 269: 16802-16809, 1994.

1349. Pombo, C. M.; Kehrl, J. H.; Sanchez, I.; Katz, P.; Avruch, J.; Zon, L. I.; Woodgett, J. R.; Force, T.; Kyriakis, J. M.: Activation of the SAPK pathway by the human STE20 homologue germinal centre kinase. Nature 377: 750-754, 1995.

1350. Ren, M.; Zeng, J.; De Lemos-Chiarandini, C.; Rosenfeld, M.; Adesnik, M.; Sabatini, D. D.: In its active form, the GTP-binding protein rab8 interacts with a stress-activated protein kinase. Proc. Nat. Acad. Sci. 93: 5151-5155, 1996.

1351. Sparks, A. B.; Hoffman, N. G.; McConnell, S. J.; Fowlkes, D. M.; Kay, B. K.: Cloning of ligand targets: systematic isolation of SH3 domain-containing proteins. Nature Biotech. 14: 741-744, 1996.

1352. Chang, H. Y.; Nishitoh, H.; Yang, X.; Ichijo, H.; Baltimore, D.: Activation of apoptosis signal-regulating kinase 1 (ASK1) by the adapter protein Daxx. Science 281: 1860-1863, 1998.

1353. Geleziunas, R.; Xu, W.; Takeda, K.; Ichijo, H.; Greene, W. C.: HIV-1 Nef inhibits ASK1-dependent death signalling providing a potential mechanism for protecting the infected host cell. Nature 410: 834-838, 2001.

1354. Ichijo, H.; Nishida, E.; Irie, K.; ten Dijke, P.; Saitoh, M.; Moriguchi, T.; Takagi, M.; Matsumoto, K.; Miyazono, K.; Gotoh, Y.: Induction of apoptosis by ASK1, a mammalian MAPKKK that activates SAPK/JNK and p38 signaling pathways. Science 275: 90-94, 1997.

1355. Nishitoh, H.; Saitoh, M.; Mochida, Y.; Takeda, K.; Nakano, H.; Rothe, M.; Miyazono, K.; Ichijo, H.: ASK1 is essential for JNK/SAPK activation by TRAF2. Molec. Cell 2: 389-395, 1998.

1356. Tomasetto, C.; Regnier, C.; Moog-Lutz, C.; Mattei, M. G.; Chenard, M. P.; Lidereau, R.; Basset, P.; Rio, M. C.: Identification of four novel human genes amplified and overexpressed in breast carcinoma and localized to the q11-q21.3 region of chromosome 17. Genomics 28:367-376, 1995.

1357. Oyake, T.; Itoh, K.; Motohashi, H.; Hayashi, N.; Hoshino, H.; Nishizawa, M.; Yamamoto, M.; Igarashi, K.: Bach proteins belong to a novel family of BTB-basic leucine zipper transcription factors that interact with MafK and regulate transcription through the NF-E2 site. Molec. Cell. Biol. 16: 6083-6095, 1996.

1358. Johnson, L.; Mercer, K.; Greenbaum, D.; Bronson, R. T.; Crowley, D.; Tuveson, D. A.; Jacks, T.: Somatic activation of the K-ras oncogene causes early onset lung cancer in mice. Nature 410: 1111-1116, 2001.

1359. Kozma, S. C.; Bogaard, M. E.; Buser, K.; Saurer, S. M.; Bos, J. L.; Groner, B.; Hynes, N. E.: The human c-Kirsten ras gene is activated by a novel mutation in codon 13 in the breast carcinoma cell line MDA-MB231. Nucleic Acids Res. 15: 5963-5971, 1987.

1360. Laghi, L.; Orbetegli, O.; Bianchi, P.; Zerbi, A.; Di Carlo, V.; Boland, C. R.; Malesci, A.: Common occurrence of multiple K-RAS mutations in pancreatic cancers with associated precursor lesions and in biliary cancers. Oncogene 21: 4301-4306, 2002.

1361. Lee, K.-H.; Lee, J.-S.; Suh, C.; Kim, S.-W.; Kim, S.-B.; Lee, J.-H.; Lee, M.-S.; Park, M.-Y.; Sun, H.-S.; Kim, S.-H.: Clinicopathologic significance of the K-ras gene codon 12 point mutation in stomach cancer: an analysis of 140 cases. Cancer 75: 2794-2801, 1995.

1362. Liu, E.; Hjelle, B.; Morgan, R.; Hecht, F.; Bishop, J. M.: Mutations of the Kirsten-ras proto-oncogene in human preleukaemia. Nature 330:186-188, 1987.

1363. McBride, O. W.; Swand, D. C.; Tronick, S. R.; Gol, R.; Klimanis, D.; Moore, D. E.; Aaronson, S. A.: Regional chromosomal localization of N-ras, K-ras-1, K-ras-2 and myb oncogenes in human cells. Nucleic Acids Res. 11: 8221-8236, 1983.

1364. McCoy, M. S.; Toole, J. J.; Cunningham, J. M.; Chang, E. H.; Lowy, D. R.; Weinberg, R. A.: Characterization of a human colon/lung carcinoma oncogene. Nature 302: 79-81, 1983.

1365. McGrath, J. P.; Capon, D. J.; Smith, D. H.; Chen, E. Y.; Seeburg, P. H.; Goeddel, D. V.; Levinson, A. D.: Structure and organization of the human Ki-ras proto-oncogene and a related processed pseudo gene. Nature 304:501-506, 1983.

1366. Motojima, K.; Urano, T.; Nagata, Y.; Shiku, H.; Tsurifune, T.; Kanematsu, T.: Detection of point mutations in the Kirsten-ras oncogene provides evidence for the multi-centricity of pancreatic carcinoma. Ann. Surg. 217: 138-143, 1993.

1367. Muller, R.; Slamon, D. J.; Adamson, E. D.; Tremblay, J. M.; Muller, D.; Cline, M. J.; Verma, I. M.: Transcription of c-onc genes c-ras (Ki) and c-fms during mouse development. Molec. Cell. Biol. 3: 1062-1069, 1983.

1368. Nakano, H.; Yamamoto, F.; Neville, C.; Evans, D.; Mizuno, T.; Perucho, M.: Isolation of transforming sequences of two human lung carcinomas: structural and functional analysis of the activated c-K-ras oncogenes. Proc. Nat. Acad. Sci. 81: 71-75, 1984.

1369. O'Brien, S. J.; Nash, W. G.; Goodwin, J. L.; Lowry, D. R.; Chang, E. H.: Dispersion of the ras family of transforming genes to four different chromosomes in man. Nature 302: 839-842, 1983.

1370. O'Connell, P.; Leppert, M.; Hoff, M.; Kumlin, E.; Thomas, W.; Cai, G.; Law, M.; White, R.: A linkage map for human chromosome 12. (Abstract) Am. J. Hum. Genet. 37: A169 only, 1985.

1371. Ohashi, H.; Ishikiriyama, S.; Fukushima, Y.: New diagnostic method for Pallister-Killian syndrome: detection of i(12p) in interphase nuclei of buccal mucosa by fluorescence in situ hybridization. Am. J. Med. Genet. 45: 123-128, 1993.

1372. Otori, K.; Oda, Y.; Sugiyama, K.; Hasebe, T.; Mukai, K.; Fujii, T.; Tajiri, H.; Yoshida, S.; Fukushima, S.; Esumi, H.: High frequency of K-ras mutations in human colorectal hyperplastic polyps. Gut 40:660-663, 1997.

1373. Peltomaki, P.; Knuutila, S.; Ritvanen, A.; Kaitila, I.; de laChapelle, A.: Pallister-Killian syndrome: cytogenetic and molecular studies. Clin. Genet. 31: 399-405, 1987.

1374. Pfeifer, G. P.: A new verdict for an old convict. Nature Genet. 29:3-4, 2001.

1375. Porta, M.; Malats, N.; Jariod, M.; Grimalt, J. O.; Rifa, J.; Carrato, A.; Guarner, L.; Salas, A.; Santiago-Silva, M.; Corominas, J. M.; Andreu, M.; Real, F. X.: Serum concentrations of organochlorine compounds and K-ras mutations in exocrine pancreatic cancer. Lancet 354: 2125-2129, 1999.

1376. Pulciani, S.; Santos, E.; Lauver, A. V.; Long, L. K.; Aaronson, S. A.; Barbacid, M.: Oncogene in solid human tumors. Nature 300:539-542, 1982.

1377. Rodenhuis, S.; van de Wetering, M. L.; Mooi, W. J.; Evers, S. G.; van Zandwijk, N.; Bos, J. L.: Mutational activation of the K-RAS oncogene: a possible pathogenetic factor in adenocarcinoma of the lung. New Eng. J. Med. 317: 929-935, 1987.

1378. Santos, E.; Martin-Zanca, D.; Reddy, E. P.; Pierotti, M. A.; DellaPorta, G.; Barbacid, M.: Malignant activation of a K-ras oncogene in lung carcinoma but not in normal tissue of the same patient. Science 223:661-664, 1984.

1379. Schinzel, A.: Tetrasomy 12p (Pallister-Killian syndrome). J. Med. Genet. 28: 122-125, 1991.

1380. Shimizu, K.; Birnbaum, D.; Ruley, M. A.; Fasano, O.; Suard, Y.; Edlund, L.; Taparowsky, E.; Goldfarb, M.; Wigler, M.: Structure of the Ki-ras gene of the human lung carcinoma cell line Calu-1. Nature 304:497-500, 1983.

1381. Sidransky, D.; Tokino, T.; Hamilton, S. R.; Kinzler, K. W.; Levin, B.; Frost, P.; Vogelstein, B.: Identification of RAS oncogene mutations in the stool of patients with curable colorectal tumors. Science 256:102-105, 1992.

1382. Smit, V. T. H. B. M.; Boot, A. J. M.; Smits, A. M. M.; Fleuren, G. J.; Cornelisse, C. J.; Bos, J. L.: KRAS codon 12 mutations occurvery frequently in pancreatic adenocarcinomas. Nucleic Acids Res. 16:7773-7782, 1988.

1383. Soukup, S.; Neidich, K.: Prenatal diagnosis of Pallister-Killian syndrome. Am. J. Med. Genet. 35: 526-528, 1990.
1384. Speleman, F.; Leroy, J. G.; Van Roy, N.; De Paepe, A.; Suijkerbuijk, R.; Brunner, H.; Looijenga, L.; Verschraegen-Spae, M.-R.; Orye, E.: Pallister-Killian syndrome: characterization of the isochromosome 12p by fluorescent in situ hybridization. Am. J. Med. Genet. 41:381-387, 1991.
1385. Takeda, S.; Ichii, S.; Nakamura, Y.: Detection of K-ras mutation in sputum by mutant-allele-specific amplification (MASA). Hum. Mutat. 2:112-117, 1993.
1386. Weinberg, R. A.: Fewer and fewer oncogenes. Cell 30: 3-4, 1982.
1387. Wenger, S. L.; Boone, L. Y.; Steele, M. W.: Mosaicism in Pallisteri (12p) syndrome. Am. J. Med. Genet. 35: 523-525, 1990.
1388. Wingo, P. A.; Ries, L. A. G.; Giovino, G. A.; Miller, D. S.; Rosenberg, H. M.; Shopland, D. R.; Thun, M. J.; Edwards, B. K.: Annual report to the nation on the status of cancer, 1973-1996, with a special section on lung cancer and tobacco smoking. J. Nat. Cancer Inst. 91: 675-690, 1999.
1389. Yanez, L.; Groffen, J.; Valenzuela, D. M.: c-K-ras mutations in human carcinomas occur preferentially in codon 12. Oncogene 1:315-318, 1987.
1390. Zakowski, M. F.; Wright, Y.; Ricci, A., Jr.: Pericardial agenesis and focal aplasia cutis in tetrasomy 12p (Pallister-Killian syndrome). Am. J. Med. Genet. 42: 323-325, 1992.
1391. Zhang, J.; Marynen, P.; Devriendt, K.; Fryns, J.-P.; Van den Berghe, H.; Cassiman, J.-J.: Molecular analysis of the isochromosome 12p in the Pallister-Killian syndrome: construction of a mouse-human hybrid cell line containing an i(12p) as the sole human chromosome. Hum. Genet. 83: 359-363, 1989.
1392. Zhang, Z.; Wang, Y.; Vikis, H. G.; Johnson, L.; Liu, G.; Li, J.; Anderson, M. W.; Sills, R. C.; Hong, H. L.; Devereux, T. R.; Jacks, T.; Guan, K.-L.; You, M.: Wildtype Kras2 can inhibit lung carcinogenesis in mice. Nature Genet. 29: 25-33, 2001.
1393. Lu, T. T.; Makishima, M.; Repa, J. J.; Schoonjans, K.; Kerr, T. A.; Auwerx, J.; Mangelsdorf, D. J.: Molecular basis for feedback regulation of bile acid synthesis by nuclear receptors. Molec. Cell 6:507-515, 2000.
1394. Repa, J. J.; Turley, S. D.; Lobaccaro, J.-M. A.; Medina, J.; Li, L.; Lustig, K.; Shan, B.; Heyman, R. A.; Dletschy, J. M.; Mangelsdorf, D. J.: Regulation of absorption and ABC1-mediated efflux of cholesterol by RXR heterodimers. Science 289: 1524-1529, 2000.
1395. Hymowitz, S. G.; Christinger, H. W.; Fuh, G.; Ultsch, M.; O'Connell, M.; Kelley, R. F.; Ashkenazi, A.; de Vos, A. M.: Triggering cell death: the crystal structure of Apo2L/TRAIL in a complex with death receptor 5. Molec. Cell 4: 563-571, 1999.
1396. Anguita, J.; Chalfant, M. L.; Civan, M. M.; Coca-Prados, M.: Molecular cloning of the human volume-sensitive chloride conductance regulatory protein, pI(Cln), from ocular ciliary epithelium. Biochem. Biophys. Res. Commun. 208: 89-95, 1995.
1397. Buyse, G.; De Greef, C.; Raeymaekers, L.; Droogmans, G.; Nilius, B.; Eggermont, J.: The ubiquitously expressed pI(Cln) protein forms homomeric complexes in vitro. Biochem. Biophys. Res. Commun. 218:822-827, 1996.
1398. Nagl, U. O.; Erdel, M.; Schmarda, A.; Seri, M.; Pinggera, G. M.; Gschwentner, M.; Duba, C.; Galietta, L. J. V.; Deetjen, P.; Utermann, G.; Paulmichl, M.: Chromosomal localization of the genes (CLNS1A and CLNS1B) coding for the swelling-dependent chloride channel I(Cln). Genomics 38:438-441, 1996.
1399. Schwartz, R. S.; Rybicki, A. C.; Nagel, R. L.: Molecular cloning and expression of a chloride channel-associated protein pI(Cln) in human young red blood cells: association with actin. Biochem. J. 327:609-616, 1997.
1400. Biunno, I.; Appierto, V.; Cattaneo, M.; Leone, B. E.; Balzano, G.; Socci, C.; Saccone, S.; Letizia, A.; Valle, G. D.; Sgaramella, V.: Isolation of a pancreas-specific gene located on human chromosome 14q31: expression analysis in human pancreatic ductal carcinomas. Genomics 46:284-286, 1997.
1401. Donoviel, D. B.; Bernstein, A.: SEL-1L maps to human chromosome 14, near the insulin-dependent diabetes mellitus locus 11. Genomics 56:232-233, 1999.
1402. Grant, B.; Greenwald, I.: The *Caenorhabditis. elegans* sel-1 gene, a negative regulator of lin-12 and glp-1, encodes a predicted extracellular protein. Genetics 143: 237-247, 1996.
1403. Grant, B.; Greenwald, I.: Structure, function and expression of SEL-1, a negative regulator of LIN-12 and GLP-1 in *C. elegans*. Development 124:637-644, 1997.
1404. O'Carroll, D.; Scherthan, H.; Peters, A. H. F. M.; Opravil, S.; Haynes, A. R.; Laible, G.; Rea, S.; Schmid, M.; Lebersorger, A.; Jerratsch, M.; Sattler, L.; Mattei, M. G.; Denny, P.; Brown, S. D. M.; Schweizer, D.; Jenuwein, T.: Isolation and characterization of Suv39h2, a second histone H3 methyltransferase gene that displays testis-specific expression. Molec. Cell. Biol. 20: 9423-9433, 2000.
1405. Drewes, G.; Ebneth, A.; Preuss, U.; Mandelkow, E. M.; Mandelkow, E.: MARK, a novel family of protein kinases that phosphorylate microtubule-associated proteins and trigger microtubule disruption. Cell 89: 297-308, 1997.
1406. Nagase, T.; Kikuno, R.; Ishikawa, K.; Hirosawa, M.; Ohara, O.: Prediction of the coding sequences of unidentified human genes. XVII. The complete sequences of 100 new cDNA clones from brain which code for large proteins in vitro. DNA Res. 7: 143-150, 2000.
1407. Yoshikawa, T.; Sanders, A. R.; Esterling, L. E.; Detera-Wadleigh, S. D.: Multiple transcriptional variants and RNA editing in C18orf1, a novel gene with LDLRA and transmembrane domains on 18p11.2. Genomics 47:246-257, 1998.
1408. Yoshikawa, T.; Sanders, A. R.; Esterling, L. E.; Overharser, J.; Garnes, J. A.; Lennon, G.; Grewal, R.; Detera-Wadleigh, S. D.: Isolation of chromosome 18-specific brain transcripts as positional candidates for bipolar disorder. Am. J. Med. Genet. (Neuropsych. Genet.) 74:140-149, 1997.
1409. Anneren, C.; Reedquist, K. A.; Bos, J. L.; Welsh, M.: GTK, a Src-related tyrosine kinase, induces nerve growth factor-independent neurite outgrowth in PC12 cells through activation of the Rap1 pathway: relationship to Shb tyrosine phosphorylation and elevated levels of focal adhesion kinase. J. Biol. Chem. 275: 29153-29161, 2000.
1410. Cance, W. G.; Craven, R. J.; Bergman, M.; Xu, L.; Alitalo, K.; Liu, E. T.: Rak, a novel nuclear tyrosine kinase expressed in epithelial cells. Cell Growth Differ. 5: 1347-1355, 1994.
1411. Cance, W. G.; Craven, R. J.; Weiner, T. M.; Liu, E. T.: Novel protein kinases expressed in human breast cancer. Int. J. Cancer 54:571-577, 1993.
1412. Lee, J.; Wang, Z.; Luoh, S.-M.; Wood, W. I.; Scadden, D. T.: Cloning of FRK, a novel human intracellular SRC-like tyrosine kinase-encoding gene. Gene 138: 247-251, 1994.

1413. Scott, A. F.: Personal Communication. Baltimore, Md. Dec. 19, 2001.

1414. Gao, J.; Yu, L.; Zhang, P.; Jiang, J.; Chen, J.; Peng, J.; Wei, Y.; Zhao, S.: Cloning and characterization of human and mouse mitochondrial elongation factor G, GFM and Gfm, and mapping of GFM to human chromosome 3q25.1-q26.2. Genomics 74: 109-114, 2001.

1415. Miura, K.; Jacques, K. M.; Stauffer, S.; Kubosaki, A.; Zhu, K.; Hirsch, D. S.; Resau, J.; Zheng, Y.; Randazzo, P. A.: ARAP1: a point of convergence for Arf and Rho signaling. Molec. Cell 9: 109-119, 2002.

1416. Koontz, J. I.; Soreng, A. L.; Nucci, M.; Kuo, F. C.; Pauwels, P.; van den Berghe, H.; Cin, P. D.; Fletcher, J. A.; Sklar, J.: Frequent fusion of the JAZF1 and JJAZ1 genes in endometrial stromal tumors. Proc. Nat. Acad. Sci. 98: 6348-6353, 2001.

1417. Fitzgerald, K. A.; Palsson-McDermott, E. M.; Bowie, A. G.; Jefferies, C. A.; Mansell, A. S.; Brady, G.; Brint, E.; Dunne, A.; Gray, P.; Harte, M. T.; McMurray, D.; Smith, D. E.; Sims, J. E.; Bird, T. A.; O'Neill, L. A. J.: Mal (MyD88-adapter-like) is required for Toll-like receptor-4 signal transduction. Nature 413: 78-83, 2001.

1418. Horng, T.; Barton, G. M.; Medzhitov, R.: TIRAP: an adapter molecule in the Toll signaling pathway. Nature Immun. 2: 835-841, 2001.

1419. Mirzayans, F.; Pearce, W. G.; MacDonald, I. M.; Walter, M. A.: Mutation of the PAX6 gene in patients with autosomal dominant keratitis. Am. J. Hum. Genet. 57: 539-548, 1995.

1420. Liang, J. C.; Chang, K. S.; Schroeder, W.; Siciliano, M.; Trujillo, J.; Stass, S.: The human myeloperoxidase gene locates on chromosome 17q22-24 and is translocated in acute promyelocytic leukemia. (Abstract) Am. J. Hum. Genet. 41: A226, 1987.

1421. Liang, J. C.; Chang, K. S.; Schroeder, W. T.; Freireich, E. J.; Stass, S. A.; Trujillo, J. M.: The myeloperoxidase gene is translocated from chromosome 17 to 15 in a patient with acute promyelocytic leukemia. Cancer Genet. Cytogenet. 30: 103-107, 1988.

1422. Miki, T.; Weil, S. C.; Rosner, G. L.; Reid, M. S.; Kidd, K. K.: An MPO cDNA clone identifies an RFLP with PstI. Nucleic Acids Res. 16:1649, 1988.

1423. Morishita, K.; Kubota, N.; Asano, S.; Kaziro, Y.; Nagata, S.: Molecular cloning and characterization of cDNA for human myeloperoxidase. J. Biol. Chem. 262: 3844-3851, 1987.

1424. Murao, S.-I.; Stevens, F. J.; Ito, A.; Huberman, E.: Myeloperoxidase: a myeloid cell nuclear antigen with DNA-binding properties. Proc. Nat. Acad. Sci. 85: 1232-1236, 1988.

1425. Nauseef, W.; Cogley, M.; McCormick, S.: Effect of the R569W missense mutation on the biosynthesis of myeloperoxidase. J. Biol. Chem. 271:9546-9549, 1996.

1426. Nauseef, W. M.; Olsson, I.; Arnljots, K.: Biosynthesis and processing of myeloperoxidase—a marker for myeloid cell differentiation. Europ. J. Haemat. 40: 97-110, 1988.

1427. Reynolds, W. F.; Hiltunen, M.; Pirskanen, M.; Mannermaa, A.; Helisalmi, S.; Lehtovirta, M.; Alafuzoff, I.; Soininen, H.: MPO and APOE epsilon-4 polymorphisms interact to increase risk for AD in Finnish males. Neurology 55:1284-1290, 2000.

1428. Robinson, T. J.; Morris, D. J.; Ledbetter, D. H.: Chromosomal assignment and regional localization of myeloperoxidase in the mouse. Cytogenet. Cell Genet. 53: 83-86, 1990.

1429. Romano, M.; Dri, P.; Dadalt, L.; Patriarca, P.; Baralle, F. E.: Biochemical and molecular characterization of hereditary myeloproliferative deficiency. Blood 90: 4126-4134, 1997.

1430. van Tuinen, P.; Johnson, K. R.; Ledbetter, S. A.; Nussbaum, R. L.; Rovera, G.; Ledbetter, D. H.: Localization of myeloperoxidase to the long arm of human chromosome 17: relationship to the 15;17 translocation of acute promyelocytic leukemia. Oncogene 1: 319-322, 1987.

1431. Weil, S. C.; Rosner, G. L.; Reid, M. S.; Chisholm, R. L.; Farber, N. M.; Spitznagel, J. K.; Swanson, M. S.: cDNA cloning of human myeloperoxidase: decrease in myeloperoxidase mRNA upon induction of HL-60 cells. Proc. Nat. Acad. Sci. 84: 2057-2061, 1987.

1432. Weil, S. C.; Rosner, G. L.; Reid, M. S.; Chisholm, R. L.; Lemons, R. S.; Swanson, M. S.; Carrino, J. J.; Diaz, M. O.; Le Beau, M. M.: Translocation and rearrangement of myeloperoxidase gene in acute promyelocytic leukemia. Science 240: 790-792, 1988.

1433. Yamada, M.; Hur, S.-J.; Hashinaka, K.; Tsuneoka, K.; Saeki, T.; Nishio, C.; Sakiyama, F.; Tsunasawa, S.: Isolation and characterization of a cDNA coding for human myeloperoxidase. Arch. Biochem. Biophys. 255:147-155, 1987.

1434. Zaki, S. R.; Austin, G. E.; Chan, W. C.; Conaty, A. L.; Trusler, S.; Trappier, S.; Lindsey, R. B.; Swan, D. C.: Chromosomal localization of the human myeloperoxidase gene by in situ hybridization using oligonucleotide probes. Genes Chromosomes Cancer 2: 266-270, 1990.

1435. Nishida, K.; Yoshida, Y.; Itoh, M.; Fukada, T.; Ohtani, T.; Shirogane, T.; Atsumi, T.; Takahashi-Tezuka, M.; Ishihara, K.; Hibi, M.; Hirano, T.: Gab-family adapter proteins act downstream of cytokine and growth factor receptors and T- and B-cell antigen receptors. Blood 93:1809-1816, 1999.

1436. Zhao, C.; Yu, D.-H.; Shen, R.; Feng, G.-S.: Gab2, a new pleckstrin homology domain-containing adapter protein, acts to uncouple signaling from ERK kinase to Elk-1. J. Biol. Chem. 274: 19649-19654, 1999.

1437. Nosaka, K.; Onozuka, M.; Kakazu, N.; Hibi, S.; Nishimura, H.; Nishino, H.; Abe, T.: Isolation and characterization of a human thiamine pyrophosphokinase cDNA. Biochem. Biophys. Acta 1517: 293-297, 2001.

1438. Nosaka, K.; Onozuka, M.; Nishino, H.; Nishimura, H.; Kawasaki, Y.; Ueyama, H.: Molecular cloning and expression of a mouse thiaminpyrophosphokinase cDNA. J. Biol. Chem. 274: 34129-34133, 1999.

1439. Zhao, R.; Gao, F.; Goldman, I. D.: Molecular cloning of human thiamin pyrophosphokinase. Biochim. Biophys. Acta 1517: 320-322, 2001.

1440. Reboul, J.; Gardiner, K.; Monneron, D.; Uze, G.; Lutfalla, G.: Comparative genomic analysis of the interferon/interleukin-10 receptor gene cluster. Genome Res. 9: 242-250, 1999.

1441. Koyama, K.; Sudo, K.; Nakamura, Y.: Isolation of 115 human chromosome 8-specific expressed-sequence tags by exon amplification. Genomics 26:245-253, 1995.

1442. Pata, I.; Tensing, K.; Metspalu, A.: A human cDNA encoding the homologue of NADH: ubiquinone oxidoreductase subunit B13. Biochim. Biophys. Acta 1350: 115-118, 1997.

1443. Russell, M. W.; du Manoir, S.; Collins, F. S.; Brody, L. C.: Cloning of the human NADH: ubiquinone oxidoreductase subunit B13: localization to chromosome 7q32 and identification of a pseudo gene on 11p15. Mammalian Genome 8: 60-61, 1997.

1444. Lee, J. W.; Choi, H.-S.; Gyuris, J.; Brent, R.; Moore, D. D.: Two classes of proteins dependent on either the presence or absence of thyroid hormone for interaction with the thyroid hormone receptor. Molec. Endocr. 9: 243-254, 1995.

1445. Venturini, L.; You, J.; Stadler, M.; Galien, R.; Lallemand, V.; Koken, M. H. M.; Mattei, M. G.; Ganser, A.; Chambon, P.; Losson, R.; de The, H.: TIF1-gamma, a novel member of the transcriptional intermediary factor 1 family. Oncogene 18: 1209-1217, 1999.

1446. Pizutti, A.; Novelli, G.; Ratti, A.; Amati, F.; Mari, A.; Calabrese, G.; Nicolis, S.; Silani, V.; Marino, B.; Scarlato, G.; Ottolenghi, S.; Dallapiccola, B.: UFD1L, a developmentally expressed ubiquitination gene, is deleted in CATCH 22 syndrome. Hum. Molec. Genet. 6: 259-265, 1997.

1447. Yamagishi, H.; Garg, V.; Matsuoka, R.; Thomas, T.; Srivastava, D.: A molecular pathway revealing a genetic basis for human cardiac and craniofacial defects. Science 283: 1158-1161, 1999.

1448. Teumer, J.; Tseng, H.; Green, H.: The human basonuclin gene. Gene 188:1-7, 1997.

1449. Tseng, H.; Green, H.: Basonuclin: a keratinocyte protein with multiple paired zinc fingers. Proc. Nat. Acad. Sci. 89: 10311-10315, 1992.

1450. Tseng, H.; Green, H.: Association of basonuclin with ability of keratinocytes to multiply and with absence of terminal differentiation. J. Cell Biol. 126: 495-506, 1994.

1451. Okamura, H.; Miyake, S.; Sumi, Y.; Yamaguchi, S.; Yasui, A.; Muijtjens, M.; Hoeijmakers, J. H. J.; van der Horst, G. T. J.: Photic induction of mPer1 and mPer2 in Cry-deficient mice lacking a biological clock. Science 286: 2531-2534, 1999.

1452. Reick, M.; Garcia, J. A.; Dudley, C.; McKnight, S. L.: NPAS2: an analog of clock operative in the mammalian forebrain. Science 293:506-509, 2001.

1453. Fardaei, M.; Rogers, M. T.; Thorpe, H. M.; Larkin, K.; Hamshere, M. G.; Harper, P. S.; Brook, J. D.: Three proteins, MBNL, MBLL and MBXL, co-localize in vivo with nuclear foci of expanded-repeat transcripts in DM1 and DM2 cells. Hum. Molec. Genet. 11: 805-814, 2002.

1454. Miller, J. W.; Urbinati, C. R.; Teng-umnuay, P.; Stenberg, M. G.; Byrne, B. J.; Thornton, C. A.; Swanson, M. S.: Recruitment of human muscle blind proteins to (CUG)n expansions associated with myotonic dystrophy. EMBO J. 19: 4439-4448, 2000.

1455. Imataka, H.; Olsen, H. S.; Sonenberg. N.: A new translational regulator with homology to eukaryotic translation initiation factor 4G. EMBO J. 16: 817-825, 1997.

1456. Levy-Strumpf, N.; Deiss, L. P.; Berissi, H.; Kimchi, A.: DAP-5, a novel homolog of eukaryotic translation initiation factor 4G isolated as a putative modulator of gamma interferon-induced programmed cell death. Molec. Cell. Biol. 17: 1615-1625, 1997.

1457. Shaughnessy, J. D., Jr.; Jenkins, N. A.; Copeland, N. G.: cDNA cloning, expression analysis, and chromosomal localization of a gene with high homology to wheat eIF (iso)-4F and mammalian eIF-4G. Genomics 39:192-197, 1997.

1458. Yamanaka, S.; Poksay, K. S.; Arnold, K. S.; Innerarity, T. L.: A novel translational repressor mRNA is edited extensively in livers containing tumors caused by the transgene expression of the apoB mRNA-editing enzyme. Genes Dev. 11: 321-333, 1997.

1459. Westendorf, J. M.; Rao, P. N.; Gerace, L.: Cloning of cDNAs for M-phase phosphoproteins recognized by the MPM2 monoclonal antibody and determination of the phosphorylated epitope. Proc. Nat. Acad. Sci. 91: 714-718, 1994.

1460. Wang, X. S.; Diener, K.; Jannuzzi, D.; Trollinger, D.; Tan, T.-H.; Lichenstein, H.; Zukowski, M.; Yao, Z.: Molecular cloning and characterization of a novel protein kinase with a catalytic domain homologous to mitogen-activated protein kinase kinase kinase. J. Biol. Chem. 271: 31607-31611, 1996.

1461. Bromme, D.; Rossi, A. B.; Smeekens, S. P.; Anderson, D. C.; Payan, D. G.: Human bleomycin hydrolase: molecular cloning, sequencing, functional expression, and enzymatic characterization. Biochemistry 35:6706-6714, 1996.

1462. Cloos, J.; Nieuwenhuis, E. J. C.; Boomsma, D. I.; Kuik, D. J.; van der Sterre, M. L. T.; Arwert, F.; Snow, G. B.; Braakhuis, B. J. M.: Inherited susceptibility to bleomycin-induced chromatid breaks in cultured peripheral blood lymphocytes. J. Nat. Cancer Inst. 91:1125-1130, 1999.

1463. Farrer, L. A.; Abraham, C. R.; Haines, J. L.; Rogaeva, E. A.; Song, Y.; McGraw, W. T.; Brindle, N.; Premkumar, S.; Scott, W. K.; Yamaoka, L. H.; Saunders, A. M.; Roses, A. D.; Auerbach, S. A.; Sorbi, S.; Duara, R.; Pericak-Vance, M. A.; St. George-Hyslop, P. H.: Association between bleomycin hydrolase and Alzheimer's disease in Caucasians. Ann. Neurol. 44: 808-811, 1998.

1464. Ferrando, A. A.; Pendas, A. M.; Llano, E.; Velasco, G.; Lidereau, R.; Lopez-Otin, C.: Gene characterization, promoter analysis, and chromosomal localization of human bleomycin hydrolase. J. Biol. Chem. 272:33298-33304, 1997.

1465. Ferrando, A. A.; Velasco, G.; Campo, E.; Lopez-Otin, C.: Cloning and expression analysis of human bleomycin hydrolase, a cysteine proteinase involved in chemotherapy resistance. Cancer Res. 56: 1746-1750, 1996.

1466. Haston, C. K.; Amos, C. I.; King, T. M.; Travis, E. L.: Inheritance of susceptibility to bleomycin-induced pulmonary fibrosis in the mouse. Cancer Res. 56: 2596-2601, 1996.

1467. Hsu, T. C.; Johnston, D. A.; Cherry, L. M.; Ramkissoon, D.; Schantz, S. P.; Jessup, J. M.; Winn, R. J.; Shirley, L.; Furlong, C.: Sensitivity to genotoxic effects of bleomycin in humans: possible relationship to environmental carcinogenesis. Int. J. Cancer 43: 403-409, 1989.

1468. Lazo, J. S.; Humphreys, C. J.: Lack of metabolism as the biochemical basis of bleomycin-induced pulmonary toxicity. Proc. Nat. Acad. Sci. 80:3064-3068, 1983.

1469. Montoya, S. E.; Aston, C. E.; DeKosky, S. T.; Kamboh, M. I.; Lazo, J. S.; Ferrell, R. E.: Bleomycin hydrolase is associated with risk of sporadic Alzheimer's disease. (Letter) Nature Genet. 18: 211-212, 1998. Note: Erratum: Nature Genet. 19: 404 only, 1998.

1470. Montoya, S. E.; Ferrell, R. E.; Lazo, J. S.: Genomic structure and genetic mapping of the human neutral cysteine protease bleomycin hydrolase. Cancer Res. 57: 4191-4195, 1997.

1471. Zheng, W.; Johnston, S. A.; Joshua-Tor, L.: The unusual active site of Gal6/bleomycin hydrolase can act as a carboxypeptidase, aminopeptidase, and peptide ligase. Cell 93: 103-109, 1998.

1472. Xu, X.-N.; Screaton, G. R.; Gotch, F. M.; Dong, T.; Tan, R.; Almond, N.; Walker, B.; Stebbings, R.; Kent, K.; Nagata, S.; Stott, J. E.; McMichael, A. J.: Evasion of cytotoxic T lymphocyte (CTL) responses by Nef-dependent induction of Fas ligand (CD95L) expression on simian immunodeficiency virus-infected cells. J. Exp. Med. 186: 7-16, 1997.

1473. Wang, B.; Kishihara, K.; Zhang, D.; Hara, H.; Nomoto, K.: Molecular cloning and characterization of a novel human receptor protein tyrosine phosphatase gene, hPTP-J: down-regulation of gene expression by PMA and calcium ionophore in Jurkat T lymphoma cells. Biochem. Biophys. Res. Commun. 231: 77-81, 1997.

1474. Wang, H; Lian, Z; Lerch, M. M.; Chen, Z; Xie, W; Ullrich, A.: Characterization of PCP-2, a novel receptor protein tyrosine phosphatase of the MAM domain family. Oncogene 12: 2555-2562, 1996.

1475. Khoja, H.; Wang, G.; Ng, C.-T. L.; Tucker, J.; Brown, T.; Shyamala, V.: Cloning of CCRL1, an orphan seven transmembrane receptor related to chemokine receptors, expressed abundantly in the heart. Gene 246:229-238, 2000.

1476. Schweickart, V. L.; Epp, A.; Raport, C. J.; Gray, P. W.: CCR11 is a functional receptor for the monocyte chemoattractant protein family of chemokines. J. Biol. Chem. 275: 9550-9556, 2000. Note: Erratum: J. Biol. Chem. 276: 856 only, 2001.

1477. Ungar, D.; Oka, T.; Brittle, E. E.; Vasile, E.; Lupashin, V. V.; Chatterton, J. E.; Heuser, J. E.; Krieger, M.; Waters, M. G.: Characterization of a mammalian Golgi-localized protein complex, COG, that is required for normal Golgi morphology and function. J. Cell Biol. 157: 405-415, 2002.

1478. Dabovic, B.; Chen, Y.; Colarossi, C.; Obata, H.; Zambuto, L.; Perle, M. A.; Rifkin, D. B.: Bone abnormalities in latent TGF-beta binding protein (Ltbp)-3-null mice indicate a role for Ltbp-3 in modulating TGF-beta bioavailability. J. Cell Biol. 156: 227-232, 2002.

1479. Li, X.; Yin, W.; Perez-Jurado, L.; Bonadio, J.; Francke, U.: Mapping of human and murine genes for latent TGF-beta binding protein-2 (LTBP2). Mammalian Genome 6: 42-45, 1995.

1480. Sawicki, M.; Arnold, E.; Ebrahimi, S.; Duell, T.; Jin, S.; Wood, T.; Chakrabarti, R.; Peters, J.; Wan, Y.; Samara, G.; Weier, H.-U. G.; Udar, N.; Passaro, E., Jr.; Srivatsan, E. S.: A transcript map encompassing the multiple endocrine neoplasia type-1 (MEN1) locuson chromosome 11q13. Genomics 42: 405-412, 1997.

1481. Yin, W.; Smiley, E.; Germiller, J.; Mechan, R. P.; Florer, J. B.; Wenstrup, R. J.; Bonadio, J.: Isolation of a novel latent transforming growth factor-beta binding protein gene (LTBP-3). J. Biol. Chem. 270:10147-10160, 1995.

1482. Bussemakers, M. J. G.; van Bokhoven, A.; Voller, M.; Smit, F. P.; Schalken, J. A.: The genes for the calcium-dependent cell adhesion molecules P- and E-cadherin are tandemly arranged in the human genome. Biochem. Biophys. Res. Commun. 203: 1291-1294, 1994.

1483. Carmeliet, P.; Lampugnani, M.-G.; Moons, L.; Breviario, F.; Compernolle, V.; Bono, F.; Balconi, G.; Spagnuolo, R.; Oosthuyse, B.; Dewerchin, M.; Zanetti, A.; Angellilo, A.; and 11 others: Targeted deficiency of cytosolic truncation of the VE-cadherin gene in mice impairs VEGF-mediated endothelial survival and angiogenesis. Cell 98: 147-157, 1999.

1484. Huber, P.; Dalmon, J.; Engiles, J.; Breviario, F.; Gory, S.; Siracusa, L. D.; Buchberg, A. M.; Dejana, E.: Genomic structure and chromosomal mapping of the mouse VE-cadherin gene (Cdh5). Genomics 32: 21-28, 1996.

1485. Salomon, D.; Ayalon, O.; Patel-King, R.; Hynes, R. O.; Geiger, B.: Extrajunctional distribution of N-cadherin in cultured human endothelial cells. J. Cell Sci. 102: 7-17, 1992.

1486. Castagnola, P.; Gennari, M.; Morello, R.; Tonachini, L.; Marin, O.; Gaggero, A.; Cancedda, R.: Cartilage associated protein (CASP) is a novel developmentally regulated chick embryo protein. J. Cell Sci. 110: 1351-1359, 1997.

1487. Morello, R.; Tonachini, L.; Monticone, M.; Viggiano, L.; Rocchi, M.; Cancedda, R.; Castagnola, P.: cDNA cloning, characterization and chromosome mapping of Crtap encoding the mouse cartilage associated protein. Matrix Biol. 18: 319-324, 1999.

1488. Tonachini, L.; Morello, R.; Monticone, M.; Skaug, J.; Scherer, S. W.; Cancedda, R.; Castagnola, P.: cDNA cloning, characterization and chromosome mapping of the gene encoding human cartilage associated protein (CRTAP). Cytogenet. Cell Genet. 87: 191-194, 1999.

1489. Shibanuma, M.; Mashimo, J.; Mita, A.; Kuroki, T.; Nose, K.: Cloning from a mouse osteoblastic cell line of a set of transforming-growth-factor-beta-1-regulated genes, one of which seems to encode a follistatin-related polypeptide. Europ. J. Biochem. 217: 13-19, 1993.

1490. Tanaka, M.; Ozaki, S.; Osakada, F.; Mori, K.; Okubo, M.; Nakao, K.: Cloning of follistatin-related protein as a novel autoantigenin systemic rheumatic diseases. Int. Immun. 10: 1305-1314, 1998.

1491. Zwijsen, A.; Blockx, H.; van Arnhem, W.; Willems, J.; Fransen, L.; Devos, K.; Raymackers, J.; van de Voorde, A.; Slegers, H.: Characterization of a rat C6 glioma-secreted follistatin-related protein (FRP): cloning and sequence of the human homologue. Europ. J. Biochem. 225: 937-946, 1994.

1492. Bartles, J. R.; Wierda, A.; Zheng, L.: Identification and characterization of espin, an actin-binding protein localized to the F-actin-rich junctional plaques of Sertoli cell ectoplasmic specializations. J. Cell Sci. 109:1229-1239, 1996.

1493. Bartles, J. R.; Zheng, L.; Li, A.; Wierda, A.; Chen, B.: Smallespin: a third actin-bundling protein and potential forked protein ortholog in brush border microvilli. J. Cell Biol. 143: 107-119, 1998.

1494. Chen, B.; Li, A.; Wang, D.; Wang, M.; Zheng, L.; Bartles, J. R.: Espin contains an additional actin-binding site in its N terminus and is a major actin-bundling protein of the Sertoli cell-spermatidectoplasmic specialization junctional plaque. Molec. Biol. Cell 10:4327-4339, 1999.

1495. Zheng, L.; Sekerkova, G.; Vranich, K.; Tilney, L. G.; Mugnaini, E.; Bartles, J. R.: The deaf jerker mouse has a mutation in the geneen coding the espin actin-bundling proteins of hair cell stereocilia and lacks espins. Cell 102: 377-385, 2000.

1496. Parker, N. J.; Begley, C. G.; Smith, P. J.; Fox, R. M.: Molecular cloning of a novel human gene (D11S4896E) at chromosomal region 11p15.5. Genomics 37:253-256, 1996.

1497. Sabbioni, S.; Veronese, A.; Trubia, M.; Taramelli, R.; Barbanti-Brodano, G.; Croce, C. M.; Negrini, M.: Exon structure and promoter identification of STIM1 (alias GOK), a human gene causing growth arrest of the human tumor cell lines G401 and RD. Cytogenet. Cell. Genet. 86: 214-218, 1999.

1498. Cao, H.; Hegele, R. A.: Identification of single-nucleotide polymorphisms in the human LPIN1 gene. J. Hum. Genet. 47: 370-372, 2002.

1499. Peterfy, M.; Phan, J.; Xu, P.; Reue, K.: Lipodystrophy in the fld mouse results from mutation of a new gene encoding a nuclear protein, lipin. Nature Genet. 27: 121-124, 2001.

1500. Reue, K.; Xu, P.; Wang, X.-P.; Slavin, B. G.: Adipose tissue deficiency, glucose intolerance, and increased atherosclerosis result from mutation in the mouse fatty liver dystrophy (fld) gene. J. Lipid Res. 41:1067-1076, 2000.

1501. Bodine, S. C.; Latres, E.; Baumhueter, S.; Lai, V. K.-M.; Nunez, L.; Clarke, B. A.; Poueymirou, W. T.; Panaro, F. J.; Na, E.; Dharmarajan, K.; Pan, Z.-Q.; Valenzuela, D. M.; DeChiara, T. M.; Stitt, T. N.; Yancopoulos, G. D.; Glass, D. J.: Identification of ubiquitin ligases required for skeletal muscle atrophy. Science 294: 1704-1708, 2001.

1502. Centner, T.; Yano, J.; Kimura, E.; McElhinny, A. S.; Pelin, K.; Witt, C. C.; Bang, M.-L.; Trombitas, K.; Granzier, H.; Gregorio, C. C.; Sorimachi, H.; Labeit, S.: Identification of muscle specific ring finger proteins as potential regulators of the titin kinase domain. J. Molec. Biol. 306: 717-726, 2001.

1503. Kirikoshi, H.; Koike, J.; Sagara, N.; Saitoh, T.; Tokuhara, M.; Tanaka, K.; Sekihara, H.; Hirai, M.; Katoh, M.: Molecular cloning and genomic structure of human Frizzled-3 at chromosome 8p21. Biochem. Biophys. Res. Commun. 271: 8-14, 2000.

1504. Sala, C. F.; Formenti, E.; Terstappen, G. C.; Caricasole, A.: Identification, gene structure, and expression of human frizzled-3(FZD3). Biochem. Biophys. Res. Commun. 273: 27-34, 2000.

1505. Chen, H.; Ross, C. A.; Wang, N.; Huo, Y.; MacKinnon, D. F.; Potash, J. B.; Simpson, S. G.; McMahon, F. J.; DePaulo, J. R., Jr.; Mcinnis, M. G.: NEDD4L on human chromosome 18q21 has multiple forms of transcripts and is a homologue of the mouse Nedd-4-2 gene. Europ. J. Hum. Genet. 9:922-930, 2001.

1506. Erdeniz, N.; Rothstein, R.: Rsp5, a ubiquitin-protein ligase, is involved in degradation of the single-stranded-DNA binding protein Rfa1 in *Saccharomyces cerevisiae*. Molec. Cell. Biol. 20: 224-232, 2000.

1507. Bement, W. M.; Wirth, J. A.; Mooseker, M. S.: Cloning and mRNA expression of human unconventional myosin-IC: a homologue of amoeboidmyosins-I with a single IQ motif and an SH3 domain. J. Molec. Biol. 243:356-363, 1994.

1508. Dry, K.; Kenwrick, S.; Rosenthal, A.; Platzer, M.: The complete sequence of the human locus for NgCAM-related cell adhesion moleculere veals a novel alternative exon in chick and man and conserved genomic organization for the L1 subfamily. Gene 273: 115-122, 2001.

1509. Grumet, M.; Mauro, V.; Burgoon, M. P.; Edelman, G. M.; Cunningham, B. A.: Structure of a new nervous system glycoprotein, Nr-CAM, and its relationship to subgroups of neural cell adhesion molecules. J. Cell. Biol. 113: 1399-1412, 1991.

1510. Kayyem, J. F.; Roman, J. M.; de la Rosa, E. J.; Schwarz, U.; Dreyer, W. J.: Bravo/Nr-CAM is closely related to the cell adhesion molecules L1 and Ng-CAM and has a similar heterodimer structure. J. Cell. Biol. 118:1259-1270, 1992.

1511. Lane, R. P.; Chen, X.-N.; Yamakawa, K.; Vielmetter, J.; Korenberg, J. R.; Dreyer, W. J.: Characterization of a highly conserved human homolog to the chicken neural cell surface protein Bravo/Nr-CAM that maps to chromosome band 7q31. Genomics 35: 456-465, 1996.

1512. Wang, B.; Williams, H.; Du, J.-S.; Terrett, J.; Kenwrick, S.: Alternative splicing of human NrCAM in neural and nonneural tissues. Molec. Cell. Neurosci. 10: 287-295, 1998.

1513. Damen, J. E.; Liu, L.; Rosten, P.; Humphries, R. K.; Jefferson, A. B.; Majerus, P. W.; Krystal, G.: The 145-kDa protein induced to associate with Shc by multiple cytokines is an inositol tetraphosphate and phosphatidylinositol 3,4,5-triphosphate 5-phosphatase. Proc. Nat. Acad. Sci. 93: 1689-1693, 1996.

1514. Drayer, A. L.; Pesesse, X.; De Smedt, F.; Woscholski, R.; Parker, P.; Erneux, C.: Cloning and expression of a human placenta inositol 1,3,4,5-tetrakisphosphate and phosphatidylinositol 3,4,5-triphosphate5-phosphatase. Biochem. Biophys. Res. Commun. 225: 243-249, 1996.

1515. Helgason, C. D.; Damen, J. E.; Rosten, P.; Grewal, R.; Sorensen, P.; Chappel, S. M.; Borowski, A.; Jirik, F.; Krystal, G.; Humphries, R. K.: Targeted disruption of SHIP leads to hemopoietic perturbations, lung pathology, and a shortened life span. Genes Dev. 12: 1610-1620, 1998.

1516. Huber, M.; Helgason, C. D.; Damen, J. E.; Liu, L.; Humphries, R. K.; Krystal, G.: The src homology 2-containing inositol phosphatase (SHIP) is the gatekeeper of mast cell degranulation. Proc. Nat. Acad. Sci. 95: 11330-11335, 1998.

1517. Kavanaugh, W. M.; Pot, D. A.; Chin, S. M.; Deuter-Reinhard, M.; Jefferson, A. B.; Norris, F. A.; Masiarz, F. R.; Cousens, L. S.; Majerus, P. W.; Williams, L. T.: Multiple forms of an inositol polyphosphate5-phosphatase form signaling complexes with Shc and Grb2. Curr. Biol. 6: 438-445, 1996.

1518. Lioubin, M. N.; Algate, P. A.; Tsai, S.; Carlberg, K.; Aebersold, R.; Rohrschneider, L. R.: p150(Ship), a signal transduction molecule with inositol polyphosphate-5-phosphatase activity. Genes Dev. 10:1084-1095, 1996.

1519. Liu, Q.; Amgen EST Program; Dumont, D. J.: Molecular cloning and chromosomal localization in human and mouse of the SH2-containing inositol phosphatase, INPP5D (SHIP). Genomics 39: 109-112, 1997.

1520. Liu, Q.; Shalaby, F.; Jones, J.; Bouchard, D.; Dumont, D. J.: The 5H2-containing inositol polyphosphate 5-phosphatase, Ship, is expressed during hematopoiesis and spermatogenesis. Blood 91: 2753-2759, 1998.

1521. Takeshita, S.; Namba, N.; Zhao, J. J.; Jiang, Y.; Genant, H. K.; Silva, M. J.; Brodt, M. D.; Helgason, C. D.; Kalesnikoff, J.; Rauh, M. J.; Humphries, R. K.; Krystal, G.; Teitelbaum, S. L.; Ross, F. P.: SHIP-deficient mice are severely osteoporotic due to increased numbers of hyper-resorptive osteoclasts. Nature Med. 8: 943-949, 2002.

1522. Wang, J.-W.; Howson, J. M.; Ghansah, T.; Desponts, C.; Ninos, J. M.; May, S. L.; Nguyen, K. H. T.; Toyama-Sorimachi, N.; Kerr, W. G.: Influence of SHIP on the NK repertoire and allogeneic bone marrow transplantation. Science 295: 2094-2097, 2002.

1523. Ware, M. D.; Rosten, P.; Damen, J. E.; Liu, L.; Humphries, R. K.; Krystal, G.: Cloning and characterization of human SHIP, the 145-kD inositol 5-phosphatase that associates with SHC after cytokine stimulation. Blood 88: 2833-2840, 1996.

1524. Stegmaier, K.; Pendse, S.; Barker, G. F.; Bray-Ward, P.; Ward, D. C.; Montgomery, K. T.; Krauter, K. S.; Reynolds, C.; Sklar, J.; Donnelly, M.; Bohlander, S. K.; Rowley, J. D.; Sallan, S. E.; Gilliland, D. G.; Golub, T. R.: Frequent loss of heterozygosity at the TEL gene locus in acute lymphoblastic leukemia of childhood. Blood 86: 38-44, 1995.

1525. Chen, C.-F.; Chen, Y.; Dai, K.; Chen, P.-L.; Riley, D. J.; Lee, W.-H.: A new member of the hsp90 family of molecular chaperones interacts with the retinoblastoma protein during mitosis and after heat shock. Molec. Cell. Biol. 16: 4691-4699, 1996.

1526. Felts, S. J.; Owen, B. A. L.; Nguyen, P.; Trepel, J.; Donner, D. B.; Toft, D. O.: The hsp90-related protein TRAP1 is a mitochondrial protein with distinct functional properties. J. Biol. Chem. 275:3305-3312, 2000.

1527. Song, H. Y.; Dunbar, J. D.; Zhang, Y. X.; Guo, D.; Donner, D. B.: Identification of a protein with homology to hsp90 that binds the type 1 tumor necrosis factor receptor. J. Biol. Chem. 270: 3574-3581, 1995.

1528. Bates, E. E. M.; Dieu, M.-C.; Ravel, O.; Zurawski, S. M.; Patel, S.; Bridon, J.-M.; Ait-Yahia, S.; Vega, F., Jr.; Banchereau, J.; Lebecque, S.: CD40L activation of dendritic cells down-regulates DORA, a novel member of the immunoglobulin superfamily. Molec. Immun. 35: 513-524, 1998.

1529. Bates, E. E. M.; Kissenpfennig, A.; Peronne, C.; Mattei, M.-G.; Fossiez, F.; Malissen, B.; Lebecque, S.: The mouse and human IGSF6(DORA) genes map to the inflammatory bowel disease 1 locus and are embedded in an intron of a gene of unknown function. Immunogenetics 52:112-120, 2000.

1530. Koesters, R.; Adams, V.; Betts, D.; Moos, R.; Schmid, M.; Siermann, A.; Hassam, S.; Weitz, S.; Lichter, P.; Heitz, P. U.; von Knebel Doeberitz, M.; Briner, J.: Human eukaryotic initiation factor EIF2C1 gene: cDNA sequence, genomic organization, localization to chromosomal bands 1q34-p35, and expression. Genomics 61: 210-218, 1999.

1531. Martinez, J.; Patkaniowska, A.; Urlaub, H.; Luhrmann, R.; Tuschi, T.: Single-stranded antisense siRNAs guide target RNA cleavage in RNAi. Cell 110: 563-574, 2002.

1532. Hanaoka, E.; Ozaki, T.; Ohira, M.; Nakamura, Y.; Suzuki, M.; Takahashi, E.; Moriya, H.; Nakagawara, A.; Sakiyama, S.: Molecular cloning and expression analysis of the human DA41 gene and its mapping to chromosome 9q21.2-q21.3. J. Hum. Genet. 45: 188-191, 2000.

1533. Ozaki, T.; Hishiki, T.; Toyama, Y.; Yuasa, S.; Nakagawara, A.; Sakiyama, S.: Identification of a new cellular protein that can interact specifically with DAN. DNA Cell Biol. 16: 985-991, 1997.

1534. Akhmanova, A.; Hoogenraad, C. C.; Drabek, K.; Stepanova, T.; Dortland, B.; Verkerk, T.; Vermeulen, W.; Burgering, B. M.; De Zeeuw, C. I.; Grosveld, F.; Galjart, N.: CLASPs are CLIP-115 and -170 associating proteins involved in the regional regulation of microtubule dynamics in motile fibroblasts. Cell 104: 923-935, 2001.

1535. Cattanach, B. M.; Barr, J. A.; Beechey, C. V.; Martin, J.; Noebels, J.; Jones, J.: A candidate model for Angelman syndrome in the mouse. Mammalian Genome 8: 472-478, 1997.

1536. Dhar, M.; Webb, L. S.; Smith, L.; Hauser, L.; Johnson, D.; West, D. B.: A novel ATPase on mouse chromosome 7 is a candidate gene for increased body fat. Physiol. Genomics 4: 93-100, 2000.

1537. Halleck, M. S.; Lawler, J. F., Jr.; Blackshaw, S.; Gao, L.; Nagarajan, P.; Hacker, C.; Pyle, S.; Newman, J. T.; Nakanishi, Y.; Ando, H.; Weinstock, D.; Williamson, P.; Schlegel, R. A.: Differential expression of putative transbilayer amphipath transporters. Physiol. Genomics 1:139-150, 1999.

1538. Loftus, B. J.; Kim, U.-J.; Sneddon, V. P.; Kalush, F.; Brandon, R.; Fuhrmann, J.; Mason, T.; Crosby, M. L.; Barnstead, M.; Cronin, L.; Mays, A. D.; Cao, Y.; Xu, R. X.; Kang, H.-L.; Mitchell, S.; Eichler, E. E.; Harris, P. C.; Venter, J. C.; Adams, M. D.: Genome duplications and other features in 12 Mb of DNA sequence from human chromosome 16p and 16q. Genomics 60: 295-308, 1999.

1539. Asada, H.; Kawamura, Y.; Maruyama, K.; Kume, H.; Ding, R.-G.; Kanbara, N.; Kuzume, H.; Sanbo, M.; Yagi, T.; Obata, K.: Cleft palate and decreased brain gamma-aminobutyric acid in mice lacking the 67-kDa isoform of glutamic acid decarboxylase. Proc. Nat. Acad. Sci. 94:6496-6499, 1997.

1540. Brilliant, M. H.; Szabo, G.; Katarova, Z.; Kozak, C. A.; Glaser, T. M.; Greenspan, R. J.; Housman, D. E.: Sequences homologous to glutamic acid decarboxylase cDNA are present on mouse chromosomes 2 and 10. Genomics 6: 115-122, 1990.

1541. Bu, D.-F.; Tobin, A. J.: The exon-intron organization of the genes (GAD1 and GAD2) encoding two human glutamate decarboxylases (GAD-67 and GAD-65) suggests that they derive from a common ancestral GAD. Genomics 21:222-228, 1994.

1542. Condie, B. G.; Bain, G.; Gottlieb, D. I.; Capecchi, M. R.: Cleft palate in mice with a targeted mutation in the gamma-aminobutyric acid-producing enzyme glutamic acid decarboxylase 67. Proc. Nat. Acad. Sci. 94: 11451-11455, 1997.

1543. Erlander, M. G.; Tillakaratne, N. J. K.; Feldblum, S.; Patel, N.; Tobin, A. J.: Two genes encode distinct glutamate decarboxylases. Neuron 7:91-100, 1991.

1544. Kelly, C. D.; Edwards, Y.; Johnstone, A. P.; Harfst, E.; Nogradi, A.; Nussey, S. S.; Povey, S.; Carter, N. D.: Nucleotide sequence and chromosomal assignment of a cDNA encoding the large isoform of human glutamate decarboxylase. Ann. Hum. Genet. 56: 255-265, 1992.

1545. Krishnamoorthy, K. S.: Pyridoxine-dependency seizure: report of a rare presentation. Ann. Neurol. 13: 103-104, 1983.

1546. Sparkes, R. S.; Kaufman, D. L.; Heinzmann, C.; Tobin, A. J.; Mohandas, T.: Brain glutamate decarboxylase (GAD) gene assigned to human chromosome 2 by somatic cell hybrid analysis. (Abstract) Cytogenet. Cell Genet. 46:696 only, 1987.

1547. Charng, M.-J.; Zhang, D.; Kinnunen, P.; Schneider, M. D.: A novel protein distinguishes between quiescent and activated forms of the type I transforming growth factor beta receptor. J. Biol. Chem. 273:9365-9368, 1998.

1548. Wurthner, J. U.; Frank, D. B.; Felici, A.; Green, H. M.; Cao, Z.; Schneider, M. D.; McNally, J. G.; Lechleider, R. J.; Roberts, A. B.: Transforming growth factor-beta receptor-associated protein 1 is a Smad4 chaperone. J. Biol. Chem. 276: 19495-19502, 2001.

1549. Nagase, T.; Nakayama, M.; Nakajima, D.; Kikuno, R.; Ohara, O.: Prediction of the coding sequences of unidentified human genes. XX. The complete sequences of 100 new cDNA clones from brain which code for large proteins in vitro. DNA Res. 8: 85-95, 2001.

1550. Toda, T.; Iida, A.; Miwa, T.; Nakamura, Y.; Imai, T.: Isolation and characterization of a novel gene encoding nuclear protein at a locus (D11S636) tightly linked to multiple endocrine neoplasia type 1 (MEN1). Hum. Molec. Genet. 3: 465-470, 1994.

155. Spicer, A. P.; Augustine, M. L.; McDonald, J. A.: Molecular cloning and characterization of a putative mouse hyaluronan synthase. J. Biol. Chem. 271: 23400-23406, 1996.

1552. Faure, S.; Meyer, L.; Costagliola, D.; Vaneensberghe, C.; Genin, E.; Autran, B.; French ALT and IMMUNOCO Study Groups; Delfraisay, J.-F.; SEROCO Study Group; McDermott, D. H.; Murphy, P. M.; Debre, P.; Theodorou, I.; Cambadiere, C.: Rapid progression to AIDS in HIV+ individuals with a structural variant of the chemokine receptor CX(3)CR1. Science 287:2274-2277, 2000.

1553. Imai, T.; Hieshima, K.; Haskell, C.; Baba, M.; Nagira, M.; Nishimura, M.; Kakizaki, M.; Takagi, S.; Nomiyama, H.; Schall, T. J.; Yoshie, O.: Identification and molecular characterization of fractalkine receptor CX3CR1, which mediates both leukocyte migration and adhesion. Cell 91:521-530, 1997.

1554. Moatti, D.; Faure, S.; Fumeron, F.; Amara, M. E. W.; Seknadji, P.; McDermott, D. H.; Debre, P.; Aumont, M. C.; Murphy, P. M.; deprost, D.; Combadiere, C.: Polymorphism in the fractalkine receptor CX3CR1 as a genetic risk factor for coronary artery disease. Blood 97:1925-1928, 2001.

1555. Raport, C. J.; Schweickart, V. L.; Eddy, R. L., Jr.; Shows, T. B.; Gray, P. W.: The orphan G-protein-coupled receptor-encoding gene V28 is closely related to genes for chemokine receptors and is expressed in lymphoid and neural tissues. Gene 163: 295-299, 1995.

1556. Tripp, R. A.; Jones, L. P.; Haynes, L. M.; Zheng, H.; Murphy, P. M.; Anderson, L. J.: CX3C chemokine mimicry by respiratory syncytial virus G glycoprotein. Nature Immun. 2: 732-738, 2001.

1557. Park, W. S.; Lee, J. H.; Shin, M. S.; Park, J. Y.; Kim, H. S.; Lee, J. H.; Kim, Y. S.; Lee, S. N.; Xiao, W.; Park, C. H.; Lee, S. H.; Yoo, N. J.; Lee, J. Y.: Inactivating mutations of the caspase-10 gene in gastric cancer. Oncogene 21: 2919-2925, 2002.

1558. Shin, M. S.; Kim, H. S.; Kang, C. S.; Park, W. S.; Kim, S. Y.; Lee, S. N.; Lee, J. H.; Park, J. Y.; Jang, J. J.; Kim, C. W.; Kim, S. H.; Lee, J. Y.; Yoo, N. J.; Lee, S. H.: Inactivating mutations of CASP10 gene in non-Hodgkin lymphomas. Blood 99: 4094-4099, 2002.

1559. Vincenz, C.; Dixit, V. M.: Fas-associated death domain protein interleukin-1-beta-converting enzyme 2 (FLICE2), an ICE/Ced-3 homologue, is proximally involved in CD95- and p55-mediated death signaling. J. Biol. Chem. 272: 6578-6583, 1997.

1560. Wang, J.; Chun, H. J.; Wong, W.; Spencer, D. M.; Lenardo, M. J.: Caspase-10 is an initiator caspase in death receptor signaling. Proc. Nat. Acad. Sci. 98: 13884-13888, 2001.

1561. Wang, J.; Zheng, L.; Lobito, A.; Chan, F. K.; Dale, J.; Sneller, M.; Yao, X.; Puck, J. M.; Straus, S. E.; Lenardo, M. J.: Inherited human caspase 10 mutations underlie defective lymphocyte and dendritic cell apoptosis in autoimmune lymphoproliferative syndrome type II. Cell 98:47-58, 1999.

1562. Nagase, T.; Kikuno, R.; Nakayama, M.; Hirosawa, M.; Ohara, O.: Prediction of the coding sequences of unidentified human genes. XVIII. The complete sequences of 100 new cDNA clones from brain which code for large proteins in vitro. DNA Res. 7: 273-281, 2000.

1563. Nagase, T.; Ishikawa, K.; Miyajima, N.; Tanaka, A.; Kotani, H.; Nomura, N.; Ohara, O.: Prediction of the coding sequences of unidentified human genes. IX. The complete sequences of 100 new cDNA clones from brain which can code for large proteins in vitro. DNA Res. 5: 31-39, 1998.

1564. Herzing, L. B. K.; Kim, S.-J.; Cook, E. H., Jr.; Ledbetter, D. H.: The human aminophospholipid-transporting ATPase gene ATP10C maps adjacent to UBE3A and exhibits similar imprinted expression. Am. J. Hum. Genet. 68: 1501-1505, 2001.

1565. Dunlevy, J. R.; Berryhill, B. L.; Vergnes, J.-P.; Sundar-Raj, N.; Hassell, J. R.: Cloning, chromosomal localization, and characterization of cDNA from a novel gene, SH3BP4, expressed by human corneal fibroblasts. Genomics 62:519-524, 1999.

1566. Wong, W. T.; Schumacher, C.; Salcini, A. E.; Romano, A.; Castagnino, P.; Pelicci, P. G.; DiFiore, P. P.: A protein-binding domain, EH, identified in the receptor tyrosine kinase substrate Eps15 and conserved in evolution. Proc. Nat. Acad. Sci. 92: 9530-9534, 1995.

1567. Meguro, M.; Kashiwagi, A.; Mitsuya, K.; Nakao, M.; Kondo, I.; Saitoh, S.; Oshimura, M.: A novel maternally expressed gene, ATP10C, encodes a putative aminophospholipid translocase associated with Angelman syndrome. Nature Genet. 28: 19-20, 2001.

1568. Hampe, J.; Grebe, J.; Nikolaus, S.; Solberg, C.; Croucher, P. J. P.; Mascheretti, S.; Jahnsen, J.; Moum, B.; Klump, B.; Krawczak, M.; Mirza, M. M.; Foelsch, U. R.; Vatn, M.; Schreiber, S.: Association of NOD2 (CARD 15) genotype with clinical course of Crohn's disease: a cohort study. Lancet 359: 1661-1665, 2002.

1569. Hugot, J.-P.; Chamaillard, M.; Zouali, H.; Lesage, S.; Cezard, J.-P.; Belaiche, J.; Almer, S.; Tysk, C.; O'Morain, C. A.; Gassull, M.; Binder, V.; Finkel, Y.; and 8 others: Association of NOD2 leucine-rich repeat variants with susceptibility to Crohn's disease. Nature 411:599-603, 2001.

1570. Murillo, L.; Crusius, J. B. A.; van Bodegraven, A. A.; Alizadeh, B. Z.; Pena, A. S.: CARD15 gene and the classification of Crohn's disease. Immunogenetics 54: 59-61, 2002.

1571. Ogura, Y.; Bonen, D. K.; Inohara, N.; Nicolae, D. L.; Chen, F. F.; Ramos, R.; Britton, H.; Moran, T.; Karaliuskas, R.; Duerr, R. H.; Achkar, J.-P.; Brant, S. R.; Bayless, T. M.; Kirschner, B. S.; Hanauer, S. B.; Nunez, G.; Cho, J. H.: A frame shift mutation in Nod2 associated with susceptibility to Crohn's disease. Nature 411: 603-606, 2001.

1572. Ogura, Y.; Inohara, N.; Benito, A.; Chen, F. F.; Yamaoka, S.; Nunez, G.: Nod2, a Nodl/Apaf-1 family member that is restricted to monocytes and activates NF kappa-B. J. Biol. Chem. 276: 4812-4818, 2001.

1573. Lesage, S.; Zouali, H.; Cezard, J.-P.; EPWG-IBD Group; Colombel, J.-F.; EPIMAD Group; Belaiche, J.; GETAID Group; Almer, S.; Tysk, C.; O'Morain, C.; Gassull, M.; Binder, V.; Finkel, Y.; Modigliani, R.; Gower-Rousseau, C.; Macry, J.; Merlin, F.; Chamaillard, M.; Jannot, A.-S.; Thomas, G.; Hugot, J.-P.: CARD15/NOD2 mutational analysis and genotype-phenotype correlation in 612 patients with inflammatory bowel disease. Am. J. Hum. Genet. 70: 845-857, 2002.

1574. van Heel, D. A.; McGovern, D. P. B.; Cardon, L. R.; Dechairo, B. M.; Lench, N. J.; Carey, A. H.; Jewell, D. P.: Fine mapping of the IBD1 locus did not identify Crohn disease-associated NOD2 variants: implications for complex disease genetics. Am. J. Med. Genet. 111:253-259, 2002.

1575. Vermeire, S.; Wild, G.; Kocher, K.; Cousineau, J.; Dufresne, L.; Bitton, A.; Langelier, D.; Pare, P.; Lapointe, G.; Cohen, A.; Daly, M. J.; Rioux, J. D.: CARD15 genetic variation in a Quebec population: prevalence, genotype-phenotype relationship, and haplotype structure. Am. J. Hum. Genet. 71: 74-83, 2002.

1576. Yamazaki, K.; Takazoe, M.; Tanaka, T.; Kazumori, T.; Nakamura, Y.: Absence of mutation in the NOD2/CARD15 gene among 483 Japanese patients with Crohn's disease. J. Hum. Genet. 47: 469-472, 2002.

1577. Chong, S. S.; Tanigami, A.; Roschke, A. V.; Ledbetter, D. H.: 14-3-3-epsilon has no homology to LIS1 and lies telomeric to it on chromosome 17p13.3 outside the Miller-Dieker syndrome chromosome region. Genome Res. 6: 735-741, 1996.

1578. Conklin, D. S.; Galaktionov, K.; Beach, D.: 14-3-3 proteins associate with cdc25 phosphatases. Proc. Nat. Acad. Sci. 92: 7892-7896, 1995.

1579. Jin, D.-Y.; Lyu, M. S.; Kozak, C. A.; Jeang, K.-T.: Function of 14-3-3 proteins. Nature 382: 308 only, 1996.

1580. Luk, S. C. W.; Garcia-Barcelo, M.; Tsui, S. K. W.; Fung, K. P.; Lee, C. Y.; Waye, M. M. Y.: Assignment of the human 14-3-3 epsilon isoform (YWHAE) to human chromosome 17p13 by in situ hybridization. Cytogenet. Cell Genet. 78: 105-106, 1997.

1581. Slentz-Kesler, K.; Moore, J. T.; Lombard, M.; Zhang, J.; Hollingsworth, R.; Weiner, M. P.: Identification of the human Mnk2 gene (MKNK2) through protein interaction with estrogen receptor beta. Genomics 69:63-71, 2000.

1582. Li, Y.; He, X.; Schembri-King, J.; Jakes, S.; Hayashi, J.: Cloning and characterization of human Lnk, an adaptor protein with pleckstrin homology and Src homology 2 domains that can inhibit T cell activation. J. Immun. 164: 5199-5206, 2000.

1583. Takaki, S.; Sauer, K.; Iritani, B. M.; Chien, S.; Ebihara, Y.; Tsuji, K.; Takatsu, K.; Perlmutter, R. M.: Control of B cell production by the adaptor protein Lnk: definition of a conserved family of signal-modulating proteins. Immunity 13: 599-609, 2000.

1584. Burmeister, M.; Meyer, G. E.: The trefoil gene maps to mouse chromosome 17. Mammalian Genome 8: 223-224, 1997.

1585. Chinery, R.; Williamson, J.; Poulsom, R.: The gene encoding human intestinal trefoil factor (TFF3) is located on chromosome 21q22.3 clustered with other members of the trefoil peptide family. Genomics 32:281-284, 1996.

1586. Mashimo, H.; Wu, D.-C.; Podolsky, D. K.; Fishman, M. C.: Impaired defense of intestinal mucosa in mice lacking intestinal trefoil factor. Science 274:262-265, 1996.

1587. Podolsky, D. K.; Lynch-Devaney, K.; Stow, J. L.; Oates, P.; Murgue, B.; DeBeaumont, M.; Sands, B. E.; Mahida, Y. R.: Identification of human intestinal trefoil factor: goblet cell-specific expression of a peptide targeted for apical secretion. J. Biol. Chem. 268: 6694-6702, 1993.

1588. Probst, J. C.; Zetzsche, T.; Weber, M.; Theilemann, P.; Skutella, T.; Landgraf, R.; Jirikowski, G. F.: Human intestinal trefoil factor is expressed in human hypothalamus and pituitary: evidence for a novel neuropeptide. FASEB J. 10: 1518-1523, 1996.

1589. Schmitt, H.; Wundrack, I.; Beck, S.; Gott, P.; Welter, C.; Shizuya, H.; Simon, M. I.; Blin, N.: A third P-domain peptide gene (TFF3), human intestinal trefoil factor, maps to 21q22.3. Cytogenet. Cell Genet. 72: 299-302, 1996.

1590. Taupin, D.; Wu, D.-C.; Jeon, W.-K.; Devaney, K.; Wang, T. C.; Podolsky, D. K.: The trefoil gene family are coordinately expressed immediate-early genes: EGF receptor- and MAP kinase-dependent inter regulation. J. Clin. Invest. 103: R31-R38, 1999.

1591. Thim, L.: A new family of growth factor-like peptides: 'trefoil' disulphide loop structures as a common feature in breast cancer associated peptide (pS2), pancreatic spasmolytic polypeptide (PSP), and frog skin peptides (spasmolysins). FEBS Lett. 250: 85-90, 1989.

1592. England, S. K.; Uebele, V. N.; Kodali, J.; Bennett, P. B.; Tamkun, M. M.: A novel K+ channel beta-subunit (hKv-beta-1.3) is produced via alternative mRNA splicing. J. Biol. Chem. 270: 28531-28534, 1995.

1593. Aubry, F.; Mattei, M.-G.; Barque, J.-P.; Galibert, F.: Chromosomal localization and expression pattern of the RNase L inhibitor gene. FEBS Lett. 381: 135-139, 1996.

1594. Diriong, S.; Salehzada, T.; Bisbal, C.; Martinand, C.; Taviaux, S.: Localization of the ribonuclease L inhibitor gene (RNS41), anew member of the interferon-regulated 2-5A pathway, to 4q31 by fluorescencein situ hybridization. Genomics 32: 488-490, 1996.

1595. Pizzuti, A.; Amati, F.; Calabrese, G.; Mari, A.; Colosimo, A; Silani, V.; Giardino, L.; Ratti, A.; Penso, D.; Calza, L.; Palka, G.; Scarlato, G.; Novelli, G.; Dallapicolla, B.: cDNA characterization and chromosomal mapping of two human homologs of the Drosophila dishevelled polarity gene. Hum. Molec. Genet. 5: 953-958, 1996.

1596. Semenov, M. V.; Snyder, M.: Human dishevelled genes constitute a DHR-containing multigene family. Genomics 42: 302-310, 1997.

1597. Carson-Walter, E. B.; Watkins, D. N.; Nanda, A.; Vogelstein, B.; Kinzler, K. W.; St. Croix, B.: Cell surface tumor endothelial markers are conserved in mice and humans. Cancer Res. 61: 6649-6655, 2001.

1598. St. Croix, B.; Rago, C.; Velculescu, V.; Traverso, G.; Romans, K. E.; Montgomery, E.; Lal, A.; Riggins, G. J.; Lengauer, C.; Vogelstein, B.; Kinzler, K. W.: Genes expressed in human tumor endothelium. Science 289: 1197-1202, 2000.

1599. Gosling, J.; Dairaghi, D. J.; Wang, Y.; Hanley, M.; Talbot, D.; Miao, Z.; Schall, T. J.: Cutting edge: identification of a novel chemokine receptor that binds dendritic cell- and T cell-active chemokines including ELC, SLC, and TECK. J. Immun. 164: 2851-2856, 2000.

1600. Hadjantonakis, A.-K.; Formstone, C. J.; Little, P. F. R.: mCelsr1 is an evolutionarily conserved seven-pass transmembrane receptor and is expressed during mouse embryonic development. Mech. Dev. 78:91-95, 1998.

1601. Hadjantonakis, A.-K.; Sheward, W. J.; Harmar, A. J.; de Galan, L.; Hoovers, J. M. N.; Little, P. F. R.: Celsrl, a neural-specific gene encoding an unusual seven-pass transmembrane receptor, maps to mouse chromosome 15 and human chromosome 22qter. Genomics 45: 97-104, 1997.

1602. Chai, J.; Du, C.; Wu, J.-W.; Kyin, S.; Wang, X.; Shi, Y.: Structural and biochemical basis of apoptotic activation by Smac/DIABLO. Nature 406:855-862, 2000.

1603. Du, C.; Fang, M.; Li, Y.; Li, L.; Wang, X.: Smac, a mitochondrial protein that promotes cytochrome c-dependent caspase activation by eliminating IAP inhibition. Cell 102: 33-42, 2000.

1604. Okada, H.; Suh, W.-K.; Jin, J.; Woo, M.; Du, C.; Elia, A.; Duncan, G. S.; Wakeham, A.; Itie, A.; Lowe, S. W.; Wang, X.; Mak, T. W.: Generation and characterization of Smac/DIABLO-deficient mice. Molec. Cell. Biol. 22: 3509-3517, 2002.

1605. Scott, A. F.: Personal Communication. Baltimore, Md. Aug. 18, 2000.

1606. Verhagen, A. M.; Ekert, P. G.; Pakusch, M.; Silke, J.; Connolly, L. M.; Reid, G. E.; Moritz, R. L.; Simpson, R. J.; Vaux, D. L.: Identification of DIABLO, a mammalian protein that promotes apoptosis by binding to and antagonizing IAP proteins. Cell 102: 43-53, 2000.

1607. Bousquet, O.; Basseville, M.; Vila-Porcile, E.; Billette de Villemeur, T.; Hauw, J.-J.; Landrieu, P.; Portier, M.-M.: Aggregation of a subpopulation of vimentin filaments in cultured human skin fibroblasts derived from patients with giant axonal neuropathy. Cell. Motil. Cytoskeleton 33:115-129, 1996.

1608. Kuhlenbaumer, G.; Young, P.; Oberwittler, C.; Hunermund, G.; Schirmacher, A.; Domschke, K.; Ringelstein, B.; Stogbauer, F.: Giant axonal neuropathy (GAN): case report and two novel mutations in the gigaxonin gene. Neurology 58:1273-1276, 2002. Note: Erratum: Neurology 58: 1444, 2002.

1609. Pena, S. D.: Giant axonal neuropathy: an inborn error of organization of intermediate filaments. Muscle Nerve 5: 166-172, 1982.

1610. Prineas, J. W.; Ouvrier, R. A.; Wright, R. G.; Walsh, J. C.; McLeod, J. G.: Giant axonal neuropathy: a generalized 1611. Scott, A. F.: Personal Communication. Baltimore, Md. Mar. 13, 2001.
1612. Mansharamani, M.; Hewetson, A.; Chilton, B. S.: Cloning and characterization of an a typical type IV P-type ATPase that binds to the RING motif of RUSH transcription factors. J. Biol. Chem. 276: 3641-3649, 2001.
1613. Bullrich, F.; Druck, T.; Kunapuli, P.; Gomez, J.; Gripp, K. W.; Schlegelberger, B.; Lasota, J.; Aronson, M.; Cannizzaro, L. A.; Huebner, K.; Benovic, J. L.: Chromosomal mapping of the genes GPRK5 and GPRK6 encoding G protein-coupled receptor kinases GRK5 and GRK6. Cytogenet. Cell Genet. 70: 250-254, 1995.
1614. Haribabu, B.; Snyderman, R.: Identification of additional members of human G-protein-coupled receptor kinase multigene family. Proc. Nat. Acad. Sci. 90: 9398-9402, 1993.
1615. Hasson, T.; Skowron, J. F.; Gilbert, D. J.; Avraham, K. B.; Perry, W. L.; Bement, W. M.; Anderson, B. L.; Sherr, E. H.; Chen, Z.-Y.; Greene, L. A.; Ward, D. C.; Corey, D. P.; Mooseker, M. S.; Copeland, N. G.; Jenkins, N. A.: Mapping of unconventional myosins in mouse and human. Genomics 36: 431-439, 1996.
1616. Laporte, J.; Hu, L. J.; Kretz, C.; Mandel, J.-L.; Kioschis, P.; Coy, J. F.; Klauck, S. M.; Poustka, A.; Dahl, N.: A gene mutated in X-linked myotubular myopathy defines a new putative tyrosine phosphatase family conserved in yeast. Nature Genet. 13: 175-182, 1996.
1617. Chambost, H.; Van Baren, N.; Brasseur, F.; Godelaine, D.; Xerri, L.; Landi, S. J.; Theate, I.; Plumas, J.; Spagnoli, G. C.; Michel, G.; Coulie, P. G.; Olive, D.: Expression of gene MAGE-A4 in Reed-Sternberg cells. Blood 95: 3530-3533, 2000.
1618. Offenberg, H. H.; Schalk, J. A. C.; Meuwissen, R. L. J.; van Aalderen, M.; Kester, H. A.; Dietrich, A. J. J.; Heyting, C.: SCP2: a major protein component of the axial elements of synaptonemal complexes of the rat. Nucleic Acids Res. 26: 2572-2579, 1998.
1619. Schalk, J. A. C.; Offenberg, H. H.; Peters, E.; Groot, N. P. B.; Hoovers, J. M. N.; Heyting, C.: Isolation and characterization of the human SCP2 cDNA and chromosomal localization of the gene. Mammalian Genome 10: 642-644, 1999.
1620. Hatamura, I.; Kanauchi, Y.; Takahara, M.; Fujiwara, M.; Muragaki, Y.; Ooshima, A.; Ogino, T.: A nonsense mutation in TRPS1 in a Japanese family with trichorhinophalangeal syndrome type I. (Letter) Clin. Genet. 59: 366-367, 2001.
1621. Hilton, M. J.; Sawyer, J. M.; Gutierrez, L.; Hogart, A.; Kung, T. C.; Wells, D. E.: Analysis of novel and recurrent mutations responsible for the tricho-rhino-phalangeal syndromes. J. Hum. Genet. 47: 103-106, 2002.
1622. Schinkmann, K.; Blenis, J.: Cloning and characterization of a human STE20-like protein kinase with unusual cofactor requirements. J. Biol. Chem. 272: 28695-28703, 1997.
1623. Zhou, T.-H.; Ling, K.; Guo, J.; Zhou, H.; Wu, Y.-L.; Jing, Q.; Ma, L.; Pei, G.: Identification of a human brain-specific isoform of mammalian STE20-like kinase 3 that is regulated by cAMP-dependent protein kinase. J. Biol. Chem. 275: 2513-2519, 2000.
1624. Ono, Y.; Ohno, M.; Shimura, Y.: Identification of a putative RNA helicase (HRH1), a human homolog of yeast Prp22. Molec. Cell. Biol. 14:7611-7620, 1994.
1625. Wang, Y.; Cortez, D.; Yazdi, P.; Neff, N.; Elledge, S. J.; Qin, J.: BASC, a super complex of BRCA1-associated proteins involved in the recognition and repair of aberrant DNA structures. Genes Dev. 14:927-939, 2000.
1626. Thim, L.; Woldike, H. F.; Nielsen, P. F.; Christensen, M.; Lynch-Devaney, K.; Podolsky, D. K.: Characterization of human and rat intestinal trefoil factor produced in yeast. Biochemistry 34: 4757-4764, 1995.
1627. Kimura, S.; Hara, Y.; Pineau, T.; Fernandez-Salguero, P.; Fox, C. H.; Ward, J. M.; Gonzalez, F. J.: The T/ebp null mouse: thyroid-specificen hancer-binding protein is essential for the organogenesis of the thyroid, lung, ventral forebrain, and pituitary. Genes Dev. 10:60-69, 1996.
1628. Fernandes-Alnemri, T.; Armstrong, R. C.; Krebs, J.; Srinivasula, S. M.; Wang, L.; Bullrich, F.; Fritz, L. C.; Trapani, J. A.; Tomaselli, K. J.; Litwack, G.; Alnemri, E. S.: In vitro activation of CPP32 and Mch3 by Mch4, a novel human apoptotic cysteine protease containing two FADD-like domains. Proc. Nat. Acad. Sci. 93: 7464-7469, 1996.
1629. Levkau, B.; Koyama, H.; Raines, E. W.; Clurman, B. E.; Herren, B.; Orth, K.; Roberts, J. M.; Ross, R.: Cleavage of p21(Cip1/Waf1) and p27(Kip1) mediates apoptosis in endothelial cells through activation of Cdk2: role of a caspase cascade. Molec. Cell 1: 553-563, 1998.
1630. Nasir, J.; Theilmann, J. L.; Chopra, V.; Jones, A. M.; Walker, D.; Rasper, D. M.; Vaillancourt, J. P.; Hewitt, J. E.; Nicholson, D. W.; Hayden, M. R.: Localization of the cell death genes CPP32 and Mch-2 to human chromosome 4q. Mammalian Genome 8: 56-59, 1997.
1631. Tiso, N.; Pallavicini, A.; Muraro, T.; Zimbello, R.; Apolloni, E.; Valle, G.; Lanfranchi, G.; Danieli, G. A.: Chromosomal localization of the human genes, CPP32, Mch2, Mch3, and Ich-1, involved in cellular apoptosis. Biochem. Biophys. Res. Commun. 225: 983-989, 1996.
1632. Hopfner, K.-P.; Karcher, A.; Craig, L.; Woo, T. T.; Carney, J. P.; Tainer, J. A.: Structural biochemistry and interaction architecture of the DNA double-strand break repair Mre11 nuclease and Rad50-ATPase. Cell 105:473-485, 2001.
1633. Stracker, T. H.; Carson, C. T.; Weitzman, M. D.: Adenovirus oncoproteins inactivate the Mre11-Rad50-NBS1 DNA repair complex. Nature 418:348-352, 2002.
1634. Zhong, Q.; Chen, C.-F.; Li, S.; Chen, Y.; Wang, C.-C.; Xiao, J.; Chen, P.-L.; Sharp, Z. D.; Lee, W.-H.: Association of BRCA1 with the hRad50-hMre11-p95 complex and the DNA damage response. Science 285:747-750, 1999.
1635. Zhu, X.-D.; Kuster, B.; Mann, M.; Petrini, J. H. J.; de Lange, T.: Cell-cycle-regulated association of RAD50/MRE11/NBS1 with TRF2 and human telomeres. Nature Genet. 25: 347-352, 2000.
1636. Lin, Q.; Schwarz, J.; Bucana, C.; Olson, E. N.: Control of mouse cardiac morphogenesis and myogenesis by transcription factor MEF2C. Science 276:1404-1407, 1997.
1637. Fernandes-Alnemri, T.; Litwack, G.; Alnemri, E. S.: Mch2, a new member of the apoptotic Ced-3/Ice cysteine protease gene family. Cancer Res. 55: 2737-2742, 1995.
1638. Orth, K.; Chinnaiyan, A. M.; Garg, M.; Froelich, C. J.; Dixit, V. M.: The CED-3/ICE-like protease Mch2 is activated during apoptosis and cleaves the death substrate lamin A. J. Biol. Chem. 271: 16443-16446, 1996.
1639. Verhaegh, G. W. C. T.; Jongmans, W.; Jaspers, N. G. J.; Natarajan, A. T.; Oshimura, M.; Lohman, P. H. M.; Zdzienicka, M. Z.: A gene that regulates DNA replication in response to DNA damage is located on human chromosome 4q. Am. J. Hum. Genet. 57: 1095-1103, 1995.
1640. De Plaen, E.; Arden, K.; Traversari, C.; Gaforio, J. J.; Szikora, J.-P.; De Smet, C.; Brasseur, F.; van der Bruggen, P.; Lethe, B.; Lurquin, C.; Brasseur, R.; Chomez, P.; De Backer, O.; Cavenee, W.; Boon, T.: Structure, chromosomal localization, and expression of 12 genes of the MAGE family. Immunogenetics 40: 360-369, 1994.

1641. Rogner, U. C.; Wilke, K.; Steck, E.; Korn, B.; Poustka, A.: The melanoma antigen gene (MAGE) family is clustered in the chromosomal band Xq28. Genomics 29: 725-731, 1995.

1642. McDermott, J. C.; Cardoso, M. C.; Yu, Y.-T.; Andres, V.; Leifer, D.; Krainc, D.; Lipton, S. A.; Nadal-Ginard, B.: hMEF2C gene encodes skeletal muscle- and brain-specific transcription factors. Molec. Cell. Biol. 13: 2564-2577, 1993.

1643. Emes, R. D.; Ponting, C. P.: A new sequence motif linking lissencephaly, Treacher Collins and oral-facial-digital type 1 syndromes, microtubule dynamics and cell migration. Hum. Molec. Genet. 10: 2813-2820, 2001.

1644. Laporte, J.; Blondeau, F.; Buj-Bello, A.; Tentler, D.; Kretz, C.; Dahl, N.; Mandel, J.-L.: Characterization of the myotubular in dual specificity phosphatase gene family from yeast to human. Hum. Molec. Genet. 7: 1703-1712, 1998.

1645. Borggrefe, T.; Masat, L.; Wabl, M.; Riwar, B.; Cattoretti, G.; Jessberger, R.: Cellular, intracellular, and developmental expression patterns of murine SWAP-70. Europ. J. Immun. 29: 1812-1822, 1999.

1646. Borggrefe, T.; Wabl, M.; Akhmedov, A. T.; Jessberger, R.: A B-cell-specific DNA recombination complex. J. Biol. Chem. 273: 17025-17035, 1998.

1647. Masat, L.; Caldwell, J.; Armstrong, R.; Khoshnevisan, H.; Jessberger, R.; Herndier, B.; Wabl, M.; Ferrick, D.: Association of SWAP-70 with the B cell antigen receptor complex. Proc. Nat. Acad. Sci. 97: 2180-2184, 2000.

1648. Masat, L.; Liddell, R. A.; Mock, B. A.; Kuo, W.-L.; Jessberger, R.; Wabl, M.; Morse, H. C., III: Mapping of the SWAP70 gene to mouse chromosome 7 and human chromosome 11p15. Immunogenetics 51: 16-19, 2000.

1649. Shinohara, M.; Terada, Y.; Iwamatsu, A.; Shinohara, A.; Mochizuki, N.; Higuchi, M.; Gotoh, Y.; Ihara, S.; Nagata, S.; Itoh, H.; Fukui, Y.; Jessberger, R.: SWAP-70 is a guanine-nucleotide-exchange factor that mediates signalling of membrane ruffling. Nature 416: 759-763, 2002.

1650. Kamimoto, T.; Zama, T.; Aoki, R.; Muro, Y.; Hagiwara, M.: Identification of a novel kinesin-related protein, KRMP1, as a target for mitotic peptidyl-prolyl isomerase Pin1. J. Biol. Chem. 276: 37520-37528, 2001.

1651. Ansel, K. M.; Harris, R. B. S.; Cyster, J. G.: CXCL13 is required for B1 cell homing, natural antibody production, and body cavity immunity. Immunity 16:67-76, 2002.

1652. Gunn, M. D.; Ngo, V. N.; Ansel, K. M.; Ekland, E. H.; Cyster, J. G.; Williams, L. T.: A B-cell-homing chemokine made in lymphoid follicles activates Burkitt's lymphoma receptor-1. Nature 391: 799-803, 1998.

1653. Legler, D. F.; Loetscher, M.; Roos, R. S.; Clark-Lewis, I.; Baggiolini, M.; Moser, B.: B cell-attracting chemokine 1, a human CXC chemokine expressed in lymphoid tissues, selectively attracts B lymphocytes via BLR1/CXCR5. J. Exp. Med. 187: 655-660, 1998.

1654. Oh, J.; Takahashi, R.; Kondo, S.; Mizoguchi, A.; Adachi, E.; Sasahara, R. M.; Nishimura, S.; Imamura, Y.; Kitayama, H.; Alexander, D. B.; Ide, C.; Horan, T. P.; Arakawa, T.; Yoshida, H.; Nishikawa, S.; Itoh, Y.; Seiki, M.; Itohara, S.; Takahashi, C.; Noda, M.: The membrane-anchored MMP inhibitor RECK is a key regulator of extracellular matrix integrity and angiogenesis. Cell 107: 789-800, 2001.

1655. Takahashi, C.; Sheng, Z.; Horan, T. P.; Kitayama, H.; Maki, M.; Hitomi, K.; Kitaura, Y.; Takai, S.; Sasahara, R. M.; Horimoto, A.; Ikawa, Y.; Ratzkin, B. J.; Arakawa, T.; Noda, M.: Regulation of matrix metalloproteinase-9 and inhibition of tumor invasion by the membrane-anchored glycoprotein RECK. Proc. Nat. Acad. Sci. 95: 13221-13226, 1998.

1656. Nagase, T.; Ishikawa, I.; Nakajima, D.; Ohira, M.; Seki, N.; Miyajima, N.; Tanaka, A.; Kotani, H.; Nomura, N.; O'Hara, O.: Prediction of the coding sequences of unidentified human genes. VII. The complete sequences of 100 new cDNA clones from brain which can code for large proteins in vitro. DNA Res. 4: 141-150, 1997.

1657. Muto, A.; Hoshino, H.; Madisen, L.; Yanai, N.; Obinata, M.; Karasuyama, H.; Hayashi, N.; Nakauchi, H.; Yamamoto, M.; Groudine, M.; Igarashi, K.: Identification of Bach2 as a B-cell-specific partner for small Maf proteins that negatively regulate the immunoglobulin heavy chain gene 3-prime enhancer. EMBO J. 17: 5734-5743, 1998.

1658. Sasaki, S.; Ito, E.; Toki, T.; Maekawa, T.; Kanezaki, R.; Umenai, T.; Muto, A.; Nagai, H.; Kinoshita, T.; Yamamoto, M.; Inazawa, J.; Taketo, M. M.; Nakahata, T.; Igarashi, K.; Yokoyama, M.: Cloning and expression of human B cell-specific transcription factor BACH2 mapped to chromosome 6q15. Oncogene 19: 3739-3749, 2000.

1659. Amagai, M.; Wang, Y.; Minoshima, S.; Kawamura, K.; Green, K. J.; Nishikawa, T.; Shimizu, N.: Assignment of the human genes for desmocollin 3 (DSC3) and desmocollin 4 (DSC4) to chromosome 18q12. Genomics 25:330-332, 1995.

1660. Kawamura, K.; Watanabe, K.; Suzuki, T.; Yamakawa, T.; Kamiyama, T.; Nakagawa, H.; Tsurufuji, S.: cDNA cloning and expression of a novel human desmocollin. J. Biol. Chem. 269: 26295-26302, 1994.

1661. King, I. A.; Sullivan, K. H.; Bennett, R., Jr.; Buxton, R. S.: The desmocollins of human foreskin epidermis: identification and chromosomal assignment of a third gene and expression patterns of the three isoforms. J. Invest. Derm. 105: 314-321, 1995.

1662. Hoop, R. C.; Russo, L. S.; Riconda, D. L.; Schwartz, L. S.; Hoffman, E. P.: Restoration of half the normal dystrophin sequence in a double-deletion Duchenne muscular dystrophy family. Am. J. Med. Genet. 49: 323-327, 1994.

1663. Burger, J.; Fonknechten, N.; Hoeltzenbein, M.; Neumann, L.; Bratanoff, E.; Hazan, J.; Reis, A.: Hereditary spastic paraplegia caused by mutations in the SPG4 gene. Europ. J. Hum. Genet. 8: 771-776, 2000.

1664. Burger, J.; Metzke, H.; Paternotte, C.; Schilling, F.; Hazan, J.; Reis, A.: Autosomal dominant spastic paraplegia with anticipation maps to a 4-cM interval on chromosome 2p21-p24 in a large German family. Hum. Genet. 98: 371-375, 1996.

1665. Errico, A.; Ballabio, A.; Rugarli, E. I.: Spastin, the protein mutated in autosomal dominant hereditary spastic paraplegia, is involved in microtubule dynamics. Hum. Molec. Genet. 11: 153-163, 2002.

1666. Lindsey, J. C.; Lusher, M. E.; McDermott, C. J.; White, K. D.; Reid, E.; Rubinsztein, D. C.; Bashir, R.; Hazan, J.; Shaw, P. J.; Bush by, K. M. D.: Mutation analysis of the spastin gene (SPG4) inpatients with hereditary spastic paraplegia. J. Med. Genet. 37:759-765, 2000.

1667. Takahashi, N.; Tuiki, H.; Saya, H.; Kaibuchi, K.: Localization of the gene coding for ROCK II/Rho kinase on human chromosome 2p24. Genomics 55:235-237, 1999.

1668. Kedra, D.; Pan, H.-Q.; Seroussi, E.; Fransson, I.; Guilbaud, C.; Collins, J. E.; Dunham, I.; Blennow, E.; Roe, B. A.; Piehl, F.; Dumanski, J. P.: Characterization of the human synaptogyrin gene family. Hum. Genet. 103: 131-141, 1998.

1669. Hazan, J.; Davoine, C. S.; Mavel, D.; Fonknechten, N.; Paternotte, C.; Fizames, C.; Cruaud, C.; Samson, D.; Muselet, D.; Vega-Czarny, N.; Brice, A.; Gyapay, G.; Heilig, R.; Fontaine, B.; Weissenbach, J.: A fine integrated map of the SPG4 locus excludes an expanded CAG repeat in chromosome 2p-linked autosomal dominant spastic paraplegia. Genomics 60:309-319, 1999.

1670. Hazan, J.; Fonknechten, N.; Mavel, D.; Paternotte, C.; Samson, D.; Artiguenave, F.; Davoine, C.-S.; Cruaud, C.; Durr, A.; Wincker, P.; Brottier, P.; Cattolico, L.; Barbe, V.; Burgunder, J.-M.; Prud'homme, J.-F.; Brice, A.; Fontaine, B.; Heilig, R.; Weissenbach, J.: Spastin, a new AAA protein, is altered in the most frequent form of autosomal dominant spastic paraplegia. Nature Genet. 23: 296-303, 1999.

1671. Lee, M. P.; Brandenburg, S.; Landes, G. M.; Adams, M.; Miller, G.; Feinberg, A. P.: Two novel genes in the center of the 11p15 imprinted domain escape genomic imprinting. Hum. Molec. Genet. 8: 683-690, 1999.

1672. Nakayama, M.; Nakajima, D.; Nagase, T.; Nomura, N.; Seki, N.; Ohara, O.: Identification of high-molecular-weight proteins with multiple EGF-like motifs by motif-trap screening. Genomics 51: 27-34, 1998.

1673. Wu, Q.; Maniatis, T.: Large exons encoding multiple ectodomains are a characteristic feature of protocadherin genes. Proc. Nat. Acad. Sci. 97: 3124-3129, 2000.

1674. Conklin, D. C.; Rixon, M. W.; Kuestner, R. E.; Maurer, M. F.; Whitmore, T. E.; Millar, R. P.: Cloning and gene expression of a novel human ribonucleoprotein. Biochim. Biophys. Acta 1492: 465-469, 2000.

1675. Kataoka, N.; Yong, J.; Kim, V. N.; Velazquez, F.; Perkinson, R. A.; Wang, F.; Dreyfuss, G.: Pre-mRNA splicing imprints mRNA in the nucleus with a novel RNA-binding protein that persists in the cytoplasm. Molec. Cell 6: 673-682, 2000.

1676. Salicioni, A. M.; Xi. M.; Vanderveer, L. A.; Balsara, B.; Testa, J. R.; Dunbrack, R. L., Jr.; Godwin, A. K.: Identification and structural analysis of human RBM8A and RBM8B: two highly conserved RNA-binding motif proteins that interact with OVCA1, a candidate tumor suppressor. Genomics 69:54-62, 2000.

1677. Zhao, X.-F.; Nowak, N. J.; Shows, T. B.; Aplan, P. D.: MAGOH interacts with a novel RNA-binding protein. Genomics 63: 145-148, 2000.

1678. Caira, F.; Antonson, P.; Pelto-Huikko, M.; Treuter, E.; Gustafsson, J.-A.: Cloning and characterization of RAP250, a novel nuclear receptor coactivator. J. Biol. Chem. 275: 5308-5317, 2000.

1679. Guan, X. Y.; Xu, J.; Anzick, S. L.; Zhang, H.; Trent, J. M.; Meltzer, P. S.: Hybrid selection of transcribed sequences from microdissected DNA: isolation of genes within amplified region at 20q11-q13.2 in breast cancer. Cancer Res. 56: 3446-3450, 1996.

1680. Ko, L.; Cardona, G. R.; Chin, W. W.: Thyroid hormone receptor-binding protein, an LXXLL motif-containing protein, functions as a general coactivator. Proc. Nat. Acad. Sci. 97: 6212-6217, 2000.

1681. Lee, S.-K.; Anzick, S. L.; Choi, J.-E.; Bubendorf, L.; Guan, X.-Y.; Jung, Y.-K.; Kallioniemi, O. P.; Kononen, J.; Trent, J. M.; Azorsa, D.; Jhun, B.-H.; Cheong, J. H.; Lee, Y. C.; Meltzer, P. S.; Lee, J. W.: A nuclear factor, ASC-2, as a cancer-amplified transcriptional coactivator essential for ligand-dependent transactivation by nuclear receptors in vivo. J. Biol. Chem. 274: 34283-34293, 1999.

1682. Mahajan, M. A.; Samuels, H. H: A new family of nuclear receptor coregulators that integrate nuclear receptor signaling through CREB-binding protein. Molec. Cell. Biol. 20: 5048-5063, 2000.

1683. Zhu, Y.; Kan, L.; Qi, C.; Kanwar, Y. S.; Yeldandi, A. V.; Rao, M. S.; Reddy, J. K.: Isolation and characterization of peroxisome proliferator-activated receptor (PPAR) interacting protein (PRIP) as a coactivator for PPAR. J. Biol. Chem. 275: 13510-13516, 2000.

1684. Hirosawa, M.; Nagase, T.; Ishikawa, K.; Kikuno, R.; Nomura, N.; Ohara, O.: Characterization of cDNA clones selected by the Gene Mark analysis from size-fractionated cDNA libraries from human brain. DNA Res. 6: 329-336, 1999.

1685. Battini, J.-L.; Rasko, J. E. J.; Miller, A. D.: A human cell-surface receptor for xenotropic and polytropic murine leukemia viruses: possible role in G protein-coupled signal transduction. Proc. Nat. Acad. Sci. 96:1385-1390, 1999.

1686. Levy, J. A.: Xenotropism: the elusive viral receptor finally uncovered. Proc. Nat. Acad. Sci. 96: 802-804, 1999.

1687. Tailor, C. S.; Nouri, A.; Lee, C. G.; Kozak, C.; Kabat, D.: Cloning and characterization of a cell surface receptor for xenotropic and polytropic murine leukemia viruses. Proc. Nat. Acad. Sci. 96: 927-932, 1999.

1688. Yang, Y.-L.; Guo, L.; Xu, S.; Holland, C. A.; Kitamura, T.; Hunter, K.; Cunningham, J. M.: Receptors for polytropic and xenotropic mouse leukaemia viruses encoded by a single gene at Rmc1. Nature Genet. 21:216-219, 1999.

1689. Hart, M. J.; Callow, M. G.; Souza, B.; Polakis, P.: IQGAP1, a calmodulin-binding protein with a ras GAP-related domain, is a potential effector for cdc42Hs. EMBO J. 15: 2997-3005, 1996.

1690. Sugimoto, N.; Imoto, I.; Fukuda, Y.; Kurihara, N.; Kuroda, S.; Tanigami, A.; Kaibuchi, K.; Kamiyama, R.; Inazawa, J.: IQGAP1, a negative regulator of cell-cell adhesion, is upregulated by gene amplification at 15q26 in gastric cancer cell lines HSC39 and 40A. J. Hum. Genet. 46:21-25, 2001.

1691. Weissbach, L.; Settleman, J.; Kalady, M. F.; Snijders, A. J.; Murthy, A. E.; Yan, Y.-X.; Bernards, A.: Identification of a human RasGAP-related protein containing calmodulin-binding motifs. J. Biol. Chem. 269:20517-20521, 1994.

1692. Ashford, M. L. J.; Bond, C. T.; Blair, T. A.; Adelman, J. P.: Cloning and functional expression of a rat heart KATP channel. Nature 370:456-459, 1994.

1693. Bond, C. T.; Pessia, M.; Xia, X.-M.; Lagrutta, A.; Kavanaugh, M. P.; Adelman, J. P.: Cloning and expression of a family of inward rectifier potassium channels. Receptors Channels 2: 183-191, 1994.

1694. Tucker, S. J.; James, M. R.; Adelman, J. P.: Assignment of K(ATP)-1, the cardiac ATP-sensitive potassium channel gene (KCNJ5), to human chromosome 11q24. Genomics 28: 127-128, 1995.

1695. Wickman, K.; Seldin, M. F.; Gendler, S. J.; Clapham, D. E.: Partial structure, chromosome localization, and expression of the mouse Girk4 gene. Genomics 40: 395-401, 1997.

1696. Jenkins, N. A.: Personal Communication. Frederick, Md. May 12, 1997.

1697. Zhang, Y.; Sun, Z.-W.; Iratni, R.; Erdjument-Bromage, H.; Tempst, P.; Hampsey, M.; Reinberg, D.: SAP30, a novel protein conserved between human and yeast, is a component of a histone deacetylase complex. Molec. Cell 1: 1021-1031, 1998.

1698. Radice, P.; Pensotti, V.; Jones, C.; Perry, H.; Pierotti, M. A.; Tunnacliffe, A.: The human archain gene, ARCN1, has highly conserved homologs in rice and *Drosophila*. Genomics 26: 101-106, 1995.

1699. Tunnacliffe, A.; van de Vrugt, H.; Pensotti, V.; Radice, P.: The coatomer protein delta-COP, encoded by the archain gene, is conserved across diverse eukaryotes. Mammalian Genome 7: 784-786, 1996.

1700. Langer, L. O., Jr.; Cervenka, J.; Camargo, M.: A severe autosomal recessive acromesomelic dysplasia, the Hunter-Thompson type, and comparison with the Grebe type. Hum. Genet. 81: 323-328, 1989.

1701. Robin, N. H.: Personal Communication. Cleveland, Ohio Nov. 3, 1997.

1702. Runner, M. N.: Linkage of brachypodism: a new member of linkage group V of the house mouse. J. Hered. 50: 81-84, 1959.

1703. Thomas, J. T.; Lin, K.; Nandedkar, M.; Camargo, M.; Cervenka, J.; Luyten, F. P.: A human chondrodysplasia due to a mutation in a TGF-beta superfamily member. Nature Genet. 12: 315-317, 1996.

1704. Tsumaki, N.; Tanaka, K.; Arikawa-Hirasawa, E.; Nakase, T.; Kimura, T.; Thomas, J. T.; Ochi, T.; Luyten, F. P.; Yamada, Y.: Role of CDMP-1 in skeletal morphogenesis: promotion of mesenchymal cell recruitment and chondrocyte differentiation. J. Cell Biol. 144: 161-173, 1999.

1705. Huh, T.-L.; Kim, Y.-O.; Oh, I.-U.; Song, B. J.; Inazawa, J.: Assignment of the human mitochondrial NAD(+)-specific isocitrate dehydrogenase alpha subunit (IDH3A) gene to 15q25.1-q25.2 by in situ hybridization. Genomics 31:295-296, 1996.

1706. Kim, Y.-O.; Oh, I.-U.; Park, H.-S.; Jeng, J.; Song, B. J.; Huh, T.-L.: Characterization of a cDNA clone for human NAD(+)-specific isocitrate dehydrogenase alpha-subunit and structural comparison with its isoenzymes from different species. Biochem. J. 308: 63-68, 1995.

1707. Arinami, T.; Kondo, I.; Hamaguchi, H.; Nakajima, S.: Multifocal meningiomas in a patient with a constitutional ring chromosome 22. J. Med. Genet. 23: 178-180, 1986.

1708. Petrella, R.; Levine, S.; Wilmot, P. L.; Ashar, K. D.; Casamassima, A. C.; Shapiro, L. R.: Multiple meningiomas in a patient with constitutional ring chromosome 22. Am. J. Med. Genet. 47: 184-186, 1993.

1709. Peyrard, M.; Fransson, I.; Xie, Y.-G.; Han, F.-Y.; Ruttledge, M. H.; Swahn, S.; Collins, J. E.; Dunham, I.; Collins, V. P.; Dumanski, J. P.: Characterization of a new member of the human beta-adaptin gene family from chromosome 22q12, a candidate meningioma gene. Hum. Molec. Genet. 3: 1393-1399, 1994.

1710. Peyrard, M.; Pan, H.-Q.; Kedra, D.; Fransson, I.; Swahn, S.; Hartman, K.; Clifton, S. W.; Roe, B. A.; Dumanski, J. P.: Structure of the promoter and genomic organization of the human beta-prime-adaptin gene (BAM22) from chromosome 22q12. Genomics 36: 112-117, 1996.

1711. Zankl, H.; Zang, K. D.: Correlations between clinical and cytogenetical data in 180 human meningiomas. Cancer Genet. Cytogenet. 1: 351-356, 1980.

1712. Harvey, K. F.; Dinudom, A.; Cook, D. I.; Kumar, S.: The Nedd-4-like protein KIAA0439 is a potential regulator of the epithelial sodium channel. J. Biol. Chem. 276: 8597-8601, 2001.

1713. Lees, J. A.; Saito, M.; Vidal, M.; Valentine, M.; Look, T.; Harlow, E.; Dyson, N.; Helin, K.: The retinoblastoma protein binds to a family of E2F transcription factors. Molec. Cell. Biol. 13: 7813-7825, 1993.

1714. Cloud, J. E.; Rogers, C.; Reza, T. L.; Ziebold, U.; Stone, J. R.; Picard, M. H.; Caron, A. M.; Bronson, R. T.; Lees, J. A.: Mutant mouse models reveal the relative roles of E2F1 and E2F3 in vivo. Molec. Cell. Biol. 22: 2663-2672, 2002.

1715. He, Y.; Armanious, M. K.; Thomas, M. J.; Cress, W. D.: Identification of E2F-3B, an alternative form of E2F-3 lacking a conserved N-terminal region. Oncogene 19: 3422-3433, 2000.

1716. Halford, M. M.; Armes, J.; Buchert, M.; Meskenaite, V.; Grail, D.; Hibbs, M. L.; Wilks, A. F.; Farlie, P. G.; Newgreen, D. F.; Hovens, C. M.; Stacker, S. A.: Ryk-deficient mice exhibit craniofacial defects associated with perturbed Eph receptor crosstalk. Nature Genet. 25:414-418, 2000.

1717. Nakamura, S.; Stock, D. W.; Wydner, K. L.; Bollekens, J. A.; Takeshita, K.; Nagai, B. M.; Chiba, S.; Kitamura, T.; Freeland, T. M.; Zhao, Z.; Minowada, J.; Lawrence, J. B.; Weiss, K. M.; Ruddle, F. H.: Genomic analysis of a new mammalian distal-less gene: Dlx7. Genomics 38:314-324, 1996.

1718. Fuhlbrigge, R. C.; Kieffer, J. D.; Armerding, D.; Kupper, T. S.: Cutaneous lymphocyte antigen is a specialized form of PSGL-1 expressed on skin-homing T cells. Nature 389: 978-981, 1997.

1719. Herron, M. J.; Nelson, C. M.; Larson, J.; Snapp, K. R.; Kansas, G. S.; Goodman, J. L.: Intracellular parasitism by the human granulocytic ehrlichiosis bacterium through the P-selectin ligand, PSGL-1. Science 288:1653-1656, 2000.

1720. Veldman, G. M.; Bean, K. M.; Cumming, D. A.; Eddy, R. L.; Sait, S. N. J.; Shows, T. B.: Genomic organization and chromosomal localization of the gene encoding human P-selectin glycoprotein ligand. J. Biol. Chem. 270: 16470-16475, 1995.

1721. Yang, J.; Galipeau, J.; Kozak, C. A.; Furie, B. C.; Furie, B.: Mouse P-selectin glycoprotein ligand-1: molecular cloning, chromosomal localization, and expression of a functional P-selectin receptor. Blood 87:4176-4186, 1996.

1722. Schwientek, T.; Nomoto, M.; Levery, S. B.; et al: Control of O-glycan branch formation. J. Biol. Chem. 274: 4504-4512, 1999.

1723. Walczak, H.; Degli-Esposti, M. A.; Johnson, R. S.; Smolak, P. J.; Waugh, J. Y.; Boiani, N.; Timour, M. S.; Gerhart, M. J.; Schooley, K. A.; Smith, C. A.; Goodwin, R. G.; Rauch, C. T.: TRAIL-R2: a novel apoptosis-mediating receptor for TRAIL. EMBO J. 16: 5386-5397, 1997.

1724. Wu, G. S.; Burns, T. F.; McDonald, E. R., III; Jiang, W.; Meng, R.; Krantz, I. D.; Kao, G.; Gan, D.-D.; Zhou, J.-Y.; Muschel, R.; Hamilton, S. R.; Spinner, N. B.; Markowitz, S.; Wu, G.; El-Deiry, W. S.: KILLER/DR5 is a DNA damage-inducible p53-regulated death receptor gene. Nature Genet. 17: 141-143, 1997.

1725. Tucker, J. E.; Winkfein, R. J.; Cooper, C. B.; Schnetkamp, P. P.: cDNA cloning of the human retinal rod Na—Ca+K exchanger: comparison with a revised bovine sequence. Invest. Ophthal. Vis. Sci. 39: 435-440, 1998.

1726. Tucker, J. E.; Winkfein, R. J.; Murthy, S. K.; Friedman, J. S.; Walter, M. A.; Demetrick, D. J.; Schnetkamp, P. P. M.: Chromosomal localization and genomic organization of the human retinal rod Na—Ca+K exchanger. Hum. Genet. 103: 411-414, 1998.

1727. Hara, Y.; Wakamori, M.; Ishii, M.; Maeno, E.; Nishida, M.; Yoshida, T.; Yamada, H.; Shimizu, S.; Mori, E.; Kudoh, J.; Shimizu, S.; Kurose, H.; Okada, Y.; Imoto, K.; Mori, Y.: LTRPC2 Ca(2+)-permeable channel activated by changes in redox status confers susceptibility to cell death. Molec. Cell 9: 163-173, 2002.

1728. Harteneck, C.; Plant, T. D.; Schultz, G.: From worm to man: three subfamilies of TRP channels. Trends Neurosci. 23: 159-166, 2000.

1729. Kudoh, J.; Nagamine, K.; Asakawa, S.; Abe, I.; Kawasaki, K.; Maeda, H.; Tsujimoto, S.; Minoshima, S.; Ito, F.; Shimizu, N.: Localization of 16 exons to a 450-kb region involved in the autoimmune polyglandular disease type I (APECED) on human chromosome 21q22.3. DNA Res. 4:45-52, 1997.

1730. Nagamine, K.; Kudoh, J.; Minoshima, S.; Kawasaki, K.; Asakawa, S.; Ito, F.; Shimizu, N.: Molecular cloning of a novel putative Ca(2+) channel protein (TRPC7) highly expressed in brain. Genomics 54:124-131, 1998.

1731. Perraud, A.-L.; Fleig, A.; Dunn, C. A.; Bagley, L. A.; Launay, P.; Schmitz, C.; Stokes, A. J.; Zhu, Q.; Bessman, M. J.; Penner, R.; Kinet, J.-P.; Scharenberg, A. M.: ADP-ribose gating of the calcium-permeable LTRPC2 channel revealed by Nudix motif homology. Nature 411: 595-599, 2001.

1732. Sano, Y.; Inamura, K.; Miyake, A.; Mochizuki, S.; Yokoi, H.; Matsushime, H.; Furuichi, K.: Immunocyte Ca(2+) influx system mediated by LTRPC2. Science 293: 1327-1330, 2001.

1733. Cerutti, A.; Schaffer, A.; Goodwin, R. G.; Shah, S.; Zan, H.; Ely, S.; Casali, P.: Engagement of CD153 (CD30 ligand) by CD30-positiveT cells inhibits class switch DNA recombination and antibody production in human IgD-positive IgM-positive B cells. J. Immun. 165: 786-794, 2000.

1734. Croager, E. J.; Abraham, L. J.: Characterisation of the human CD30 ligand gene structure. Biochim. Biophys. Acta 1353: 231-235, 1997.

1735. Smith, C. A.; Gruss, H.-J.; Davis, T.; Anderson, D.; Farrah, T.; Baker, E.; Sutherland, G. R.; Brannan, C. I.; Copeland, N. G.; Jenkins, N. A.; Grabstein, K. H.; Gliniak, B.; and 9 others: CD30 antigen, a marker for Hodgkin's lymphoma, is a receptor whose ligand defines an emerging family of cytokines with homology to TNF. Cell 73: 1349-1360, 1993.

1736. Hurskainen, T. L.; Hirohata, S.; Seldin, M. F.; Apte, S. S.: ADAM-TS5, ADAM-TS6, and ADAM-TS7, novel members of a new family of zinc metalloproteases: general features and genomic distribution of the ADAM-TS family. J. Biol. Chem. 274: 25555-25563, 1999.

1737. Gundelfinger, E.: Personal Communication. Madgeburg, FRG. Jan. 8, 1999.

1738. Hashida, H.; Goto, J.; Zhao, N.; Takahashi, N.; Hirai, M.; Kanazawa, I.; Sakaki, Y.: Cloning and mapping of ZNF231, a novel brain-specific gene encoding neuronal double zinc finger protein whose expression is enhanced in a neurodegenerative disorder, multiple system atrophy (MSA). Genomics 54: 50-58, 1998.

1739. Santorelli, F. M.; Patrono, C.; Fortini, D.; Tessa, A.; Comanducci, G.; Bertini, E.; Pierallini, A.; Amabile, G. A.; Casali, C.: Intrafamilial variability in hereditary spastic paraplegia associated with an SPG4 gene mutation. Neurology 55: 702-705, 2000.

1740. Sauter, S.; Miterski, B.; Klimpe, S.; Bonsch, D.; Schols, L.; Visbeck, A.; Papke, T.; Hopf, H. C.; Engel, W.; Deufel, T.; Epplen, J. T.; Neesen, J.: Mutation analysis of the spastin gene (SPG4) inpatients in Germany with autosomal dominant hereditary spastic paraplegia. Hum. Mutat. 20: 127-132, 2002.

1741. Svenson, I. K.; Ashley-Koch, A. E.; Pericak-Vance, M. A.; Marchuk, D. A.: A second leaky splice-site mutation in the spastin gene. (Letter) Am. J. Hum. Genet. 69: 1407-1409, 2001.

1742. Gee, S.; Krauss, S. W.; Miller, E.; Aoyagi, K.; Arenas, J.; Conboy, J. G.: Cloning of mDEAH9, a putative RNA helicase and mammalian homologue of Saccharomyces cerevisiae splicing factor Prp43. Proc. Nat. Acad. Sci. 94: 11803-11807, 1997.

1743. Imamura, O.; Sugawara, M.; Furuichi, Y.: Cloning and characterization of a putative human RNA helicase gene of the DEAH-box protein family. Biochem. Biophys. Res. Commun. 240: 335-340, 1997.

1744. Dominguez, O.; Ashhab, Y.; Sabater, L.; Belloso, E.; Caro, P.; Pujol-Borrell, R.: Cloning of ARE-containing genes by AU-motif-directed display. Genomics 54: 278-286, 1998.

1745. Kostrub, C. F.; Knudsen, K.; Subramani, S.; Enoch, T.: Hus1p, a conserved fission yeast checkpoint protein, interacts with Rad1p and is phosphorylated in response to DNA damage. EMBO J. 17: 2055-2066, 1998.

1746. Katashima, R.; Iwahana, H.; Fujimura, M.; Yamaoka, T.; Ishizuka, T.; Tatibana, M.; Itakura, M.: Molecular cloning of a human cDNA for the 41-kDa phosphoribosylpyrophosphate synthetase-associated protein. Biochim. Biophys. Acta 1396: 245-250, 1998.

1747. Katashima, R.; Iwahana, H.; Fujimura, M.; Yamaoka, T.; Itakura, M.: Assignment of the human phosphoribosylpyrophosphate synthetase-associated protein 41 gene (PRPSAP2) to 17p11.2-p12. Genomics 54: 180-181, 1998.

1748. tom Dieck, S.; Sanmarti-Vila, L.; Langnaese, K.; Richter, K.; Kindler, S.; Soyke, A.; Wex, H.; Smalla, K.-H.; Kampf, U.; Franzer, J.-T.; Stumm, M.; Garner, C. C.; Gundelfinger, E. D.: Bassoon, a novel zinc-finger CAG/glutamine-repeat protein selectively localized at the active zone of presynaptic nerve terminals. J. Cell Biol. 142: 499-509, 1998.

1749. Winter, c.; tom Dieck, S.; Boeckers, T. M.; Bockmann, J.; Kampf, U.; Sanmarti-Vila, L.; Langnaese, K.; Altrock, W.; Stumm, M.; Soyke, A.; Wieacker, P.; Garner, C. C.; Gundelfinger, E. D.: The presynaptic cytomatrix protein Bassoon: sequence and chromosomal localization of the human BSN gene. Genomics 57: 389-397, 1999.

1750. Li, J.; Ding, S.-F.; Habib, N. A.; Fermor, B. F.; Wood, C. B.; Gilmour, R. S.: Partial characterization of a cDNA for human stearoyl-CoA desaturase and changes in its mRNA expression in some normal and malignant tissues. Int. J. Cancer 57: 348-352, 1994.

1751. Ntambi, J. M.; Miyazaki, M.; Stoehr, J. P.; Lan, H.; Kendziorski, C. M.; Yandell, B. S.; Song, Y.; Cohen, P.; Friedman, J. M.; Attie, A. D.: Loss of stearoyl-CoA desaturase-1 function protects mice against adiposity. Proc. Nat. Acad. Sci. 99: 11482-11486, 2002.

1752. Thiede, M. A.; Ozols, J.; Strittmatter, P.: Construction and sequence of cDNA for rat liver stearyl coenzyme A desaturase. J. Biol. Chem. 261:13230-13235, 1986.

1753. Zhang, L.; Ge, L.; Parimoo, S.; Stenn, K.; Prouty, S. M.: Human stearoyl-CoA desaturase: alternative transcripts generated from as ingle gene by usage of tandem polyadenylation sites. Biochem. J. 340:255-264, 1999.

1754. Zheng, Y.; Eilertsen, K. J.; Ge, L.; Zhang, L.; Sundberg, J. P.; Prouty, S. M.; Stenn, K. S.; Parimoo, S.: Scd1 is expressed in sebaceous glands and is disrupted in the asebia mouse. (Letter) Nature Genet. 23:268-270, 1999.

1755. Kahn, M. L.; Zheng, Y.-W.; Huang, W.; Bigornia, V.; Zeng, D.; Moff, S.; Farese, R. V., Jr.; Tam, C.; Coughlin, S. R.: A dual thrombin receptor system for platelet activation. Nature 394: 690-694, 1998.

1756. Xu, W.-F.; Andersen, H.; Whitmore, T. E.; Presnell, S. R.; Yee, D. P.; Ching, A.; Gilbert, T.; Davie, E. W.; Foster, D. C.: Cloning and characterization of human protease-activated receptor 4. Proc. Nat. Acad. Sci. 95: 6642-6646, 1998.

1757. Matikainen, T.; Perez, G. I.; Jurisicova, A.; Pru, J. K.; Schlezinger, J. J.; Ryu, H.-Y.; Laine, J.; Sakai, T.; Korsmeyer, S. J.; Casper, R. F.; Sherr, D. H.; Tilly, J. L.: Aromatic hydrocarbon receptor-driven Bax gene expression is required for premature ovarian failure caused by biohazardous environmental chemicals. Nature Genet. 28: 355-360, 2001.

1758. Santamarina-Fojo, S.; Peterson, K.; Knapper, C.; Qiu, Y.; Freeman, L.; Cheng, J.-F.; Osorio, J.; Remaley, A.; Yang, X.-P.; Haudenschild, C.; Prades, C.; Chimini, G.; Blackmon, E.; Francois, T.; Duverger, N.; Rubin, E. M.; Rosier, M.; Denefle, P.; Fredrickson, D. S.; Brewer, H. B., Jr.: Complete genomic sequence of the human ABCA1 gene: analysis of the human and mouse ATP-binding cassette A promoter. Proc. Nat. Acad. Sci. 97: 7987-7992, 2000. Note: Erratum: Proc. Nat. Acad. Sci. 99: 1098 only, 2002.

1759. Szakacs, G.; Langmann, T.; Ozvegy, C.; Orso, E.; Schmitz, G.; Varadi, A.; Sarkadi, B.: Characterization of the ATPase cycle of human ABCA1: implications for its function as a regulator rather than an active transporter. Biochem. Biophys. Res. Commun. 288: 1258-1264, 2001.

1760. Utech, M.; Hobbel, G.; Rust, S.; Reinecke, H.; Assmann, G.; Walter, M.: Accumulation of RhoA, RhoB, RhoG, and Rac1 in fibroblasts from Tangier disease subjects suggests a regulatory role of Rho family proteins in cholesterol efflux. Biochem. Biophys. Res. Commun. 280: 229-236, 2001.

1761. Zhao, L.-X.; Zhou, C.-J.; Tanaka, A.; Nakata, M.; Hirabayashi, T.; Amachi, T.; Shioda, S.; Ueda, K.; Inagaki, N.: Cloning, characterization and tissue distribution of the rat ATP-binding cassette (ABC) transporter ABC2/ABCA2. Biochem J. 350: 865-872, 2000.

1762. Zwarts, K. Y.; Clee, S. M.; Zwinderman, A. H.; Engert, J. C.; Singaraja, R.; Loubser, O.; James, E.; Roomp, K.; Hudson, T. J.; Jukema, J. W.; Kastelein, J. J. P.; Hayden, M. R.: ABCA1 regulatory variants influence coronary artery disease independent of effects on plasma lipid levels. Clin. Genet. 61: 115-125, 2002.

1763. Kozu, T.; Henrich, B.; Schafer, K. P.: Structure and expression of the gene (HNRPA2B1) encoding the human hnRNP protein A2/B1. Genomics 25:365-371, 1995.

1764. Aruga, J.; Yokota, N.; Hashimoto, M.; Furuichi, T.; Fukuda, M.; Mikoshiba, K.: A novel zinc finger protein, Zic, is involved in neurogenesis, especially in the cell lineage of cerebellar granule cells. J. Neurochem. 63:1880-1890, 1994.

1765. Salero, E.; Perez-Sen, R.; Aruga, J.; Gimenez, C.; Zafra, F.: Transcription factors Zic1 and Zic2 bind and transactivate the apolipoprotein E gene promoter. J. Biol. Chem. 276: 1881-1888, 2001.

1766. Yokota, N.; Aruga, J.; Takai, S.; Yamada, K.; Hamazaki, M.; Iwase, T.; Sugimura, H.; Mikoshiba, K.: Predominant expression of human Zic in cerebellar granule cell lineage and medulloblastoma. Cancer Res. 56: 377-383, 1996.

1767. Shimomura, H.; Sanke, T.; Hanabusa, T.; Tsunoda, K.; Furuta, H.; Nanjo, K.: Nonsense mutation of islet-1 gene (Q310X) found in a type 2 diabetic patient with a strong family history. Diabetes 49: 1597-1600, 2000.

1768. Tanizawa, Y.; Riggs, A. C.; Dagogo-Jack, S.; Vaxillaire, M.; Froguel, P.; Liu, L.; Donis-Keller, H.; Permutt, M. A.: Isolation of the human LIM/homeodomain gene islet-1 and identification of a simple sequence repeat 1. Diabetes 43: 935-941, 1994.

1769. Corti, O.; Finocchiaro, G.; Rossi, E.; Zuffardi, O.; DiDonato, S.: Molecular cloning of cDNAs encoding human carnitine acetyltransferase and mapping of the corresponding gene to chromosome 9q34.1. Genomics 23:94-99, 1994.

1770. Kalaria, R. N.; Harik, S. I.: Carnitine acetyltransferase activity in the human brain and its microvessels is decreased in Alzheimer's disease. Ann. Neurol. 32: 583-586, 1992.

1771. van der Leij, F. R.; Huijkman, N. C. A.; Boomsma, C.; Kuipers, J. R. G.; Bartelds, B.: Genomics of the human carnitine acyltransferase genes. Molec. Genet. Metab. 71: 139-153, 2000.

1772. Ghosh, A.: Learning more about NMDA receptor regulation. Science 295:449-451, 2002.

1773. Grunwald, I. C.; Korte, M.; Wolfer, D.; Wilkinson, G. A.; Unsicker, K.; Lipp, H.-P.; Bonhoeffer, T.; Klein, R.: Kinase-independent requirement of EphB2 receptors in hippocampal synaptic plasticity. Neuron 32:1027-1040, 2001.

1774. Henderson, J. T.; Georgiou, J.; Jia, Z.; Robertson, J.; Elowe, S.; Roder, J. C.; Pawson, T.: The receptor tyrosine kinase EphB2 regulates NMDA-dependent synaptic function. Neuron 32: 1041-1056, 2001.

1775. Himanen, J.-P.; Rajashankar, K. R.; Lackmann, M.; Cowan, C. A.; Henkemeyer, M.; Nikolov, D. B.: Crystal structure of an Eph receptor-ephrin complex. Nature 414: 933-938, 2001.

1776. Takasu, M. A.; Dalva, M. B.; Zigmond, R. E.; Greenberg, M. E.: Modulation of NMDA receptor-dependent calcium influx and gene expression through EphB receptors. Science 295: 491-495, 2002.

1777. Carlberg, C.; Hooft van Huijsduijnen, R.; Staple, J. K.; DeLamarter, J. F.; Becker-Andre, M.: RZRs, a new family of retinoid-related orphan receptors that function as both monomers and homodimers. Molec. Endocr. 8:757-770, 1994.

1778. Ueda, H. R.; Chen, W.; Adachi, A.; Wakamatsu, H.; Hayashi, S.; Takasugi, T.; Nagano, M.; Nakahama, K.; Suzuki, Y.; Sugano, S.; Iino, M.; Shigeyoshi, Y.; Hashimoto, S.: A transcription factor response element for gene expression during circadian night. Nature 418:534-539, 2002.

1779. Masternak, K.; Barras, E.; Zufferey, M.; Conrad, B.; Corthals, G.; Aebersold, R.; Sanchez, J.-C.; Hochstrasser, D. F.; Mach, B.; Reith, W.: A gene encoding a novel RFX-associated transactivator is mutated in the majority of MHC class II deficiency patients. Nature Genet. 20: 273-277, 1998.

1780. Prange, C. K.; Pennacchio, L. A.; Lieuallen, K.; Fan, W.; Lennon, G. G.: Characterization of the human neurocan gene, CSPG3. Gene 221:199-205, 1998.

1781. Rauch, U.; Grimpe, B.; Kulbe, G.; Arnold-Ammer, I.; Beier, D. R.; Fassler, R.: Structure and chromosomal localization of the mouseneurocan gene. Genomics 28: 405-410, 1995.

1782. Rauch, U.; Karthikeyan, L.; Maurel, P.; Margolis, R. U.; Margolis, R. K.: Cloning and primary structure of neurocan, a developmentally regulated, aggregating chondroitin sulfate proteoglycan of brain. J. Biol. Chem. 267: 19536-19547, 1992.

1783. Barnard, R. C.; Pascall, J. C.; Brown, K. D.; McKay, I. A.; Williams, N. S.; Bustin, S. A.: Coding sequence of ERF-1, the human homologue of Tis11b/cMG1, members of the Tis11 family of early response genes. Nucleic Acids Res. 21: 3580 only, 1993.

1784. Bustin, S. A.; Xiao-Feng, N.; Barnard, R. C.; Kumar, V.; Pascall, J. C.; Brown, K. D.; Leigh, I. M.; Williams, N. S.; McKay, I. A.: Cloning and characterisation of ERF1, a 1785. Maclean, K. N.; See, C. G.; McKay, I. A.; Bustin, S. A.: The human immediate early gene BRF1 maps to chromosome 14q22-q24. Genomics 30:89-90, 1995.

1786. Ning, Z.-Q.; Norton, J. D.; Li, J.; Murphy, J. J.: Distinct mechanisms for rescue from apoptosis in Ramos human B cells by signaling through CD40 and interleukin-4 receptor: a role for inhibition of an early response gene, Berg36. Europ. J. Immun. 26: 2356-2363, 1996.

1787. Maas, S.; Kim, Y.-G.; Rich, A.: Genomic clustering of tRNA-specific adenosine deaminase ADAT1 and two tRNA synthetases. Mammalian Genome 12:387-393, 2001.

1788. Dever, T. E.; Wei, C.-L.; Benkowski, L. A.; Browning, K.; Merrick, W. C.; Hershey, J. W. B.: Determination of the amino acid sequence of rabbit, human, and wheat germ protein synthesis factor eIF-4C by cloning and chemical sequencing. J. Biol. Chem. 269: 3212-3218, 1994.

1789. Adibi, S. A.: The oligopeptide transporter (Pept-1) in human intestine: biology and function. Gastroenterology 113: 332-340, 1997.

1790. Fei, Y.-J.; Kanai, Y.; Nussberger, S.; Ganapathy, V.; Leibach, F. H.; Romero, M. F.; Singh, S. K.; Boron, W. F.; Hediger, M. A.: Expression cloning of a mammalian proton-coupled oligopeptide transporter. Nature 368:563-566, 1994.

1791. Liang, R.; Fei, Y.-J.; Prasad, P. D.; Ramamoorthy, S.; Han, H.; Yang-Feng, T. L.; Hediger, M. A.; Ganapathy, V.; Leibach, F. H.: Human intestinal H(+)/peptide cotransporter: cloning, functional expression, and chromosomal localization. J. Biol. Chem. 270: 6456-6463, 1995.

1792. Henkemeyer, M.; Orioli, D.; Henderson, J. T.; Saxton, T. M.; Roder, J.; Pawson, T.; Klein, R.: Nuk controls path finding of commissuralaxons in the mammalian central nervous system. Cell 86: 35-46, 1996.

1793. Ikegaki, N.; Tang, X. X.; Liu, X.-G.; Biegel, J. A.; Allen, C.; Yoshioka, A.; Sulman, E. P.; Brodeur, G. M.; Pleasure, D. E.: Molecular characterization and chromosomal localization of DRT (EPHT3): a developmentally regulated human protein-tyrosine kinase gene of the EPH family. Hum. Molec. Genet. 4: 2033-2045, 1995.

1794. Saito, T.; Seki, N.; Matsuda, Y.; Kitahara, M.; Murata, M.; Kanda, N.; Nomura, N.; Yamamoto, T.; Hori, T.: Identification of the human ERK gene as a putative receptor tyrosine kinase and its chromosomal localization to 1p36.1: a comparative mapping of human, mouse, and rat chromosomes. Genomics 26: 382-384, 1995.

1795. Wybenga-Groot, L. E.; Baskin, B.; Ong, S. H.; Tong, J.; Pawson, T.; Sicheri, F.: Structural basis for autoinhibition of the EphB2 receptor tyrosine kinase by the unphosphorylated juxtamembrane region. Cell 106:745-757, 2001.

1796. Reif, K.; Ekland, E. H.; Ohl, L.; Nakano, H.; Lipp, M.; Forster, R.; Cyster, J. G.: Balanced responsiveness to chemoattractants from adjacent zones determines B-cell position. Nature 416: 94-99, 2002.

1797. Inoue, I.; Taniuchi, I.; Kitamura, D.; Jenkins, N. A.; Gilbert, D. J.; Copeland, N. G.; Watanabe, T.: Characteristics of the mouse genomic histamine H1 receptor gene. Genomics 36: 178-181, 1996.

1798. Le Coniat, M.; Traiffort, E.; Ruat, M.; Arrang, J.-M.; Berger, R.: Chromosomal localization of the human histamine H1-receptor gene. Hum. Genet. 94: 186-188, 1994.

1799. Ma, R. Z.; Gao, J.; Meeker, N. D.; Fillmore, P. D.; Tung, K. S. K.; Watanabe, T.; Zachary, J. F.; Offner, H.; Blankenhorn, E. P.; Teuscher, C.: Identification of Bphs, an autoimmune disease locus, as histamine receptor H-1. Science 297: 620-623, 2002.

1800. Yamashita, M.; Fukui, H.; Sugama, K.; Horio, Y.; Ito, S.; Mizuguchi, H.; Wada, H.: Expression cloning of a cDNA encoding the bovine histamine H1 receptor. Proc. Nat. Acad. Sci. 88: 11515-11519, 1991.

1801. Bauer, S.; Groh, V.; Wu, J.; Steinle, A.; Phillips, J. H.; Lanier, L. L.; Spies, T.: Activation of NK cells and T cells by NKG2D, a receptor for stress-inducible MICA. Science 285: 727-729, 1999.

1802. Diefenbach, A.; Jensen, E. R.; Jamieson, A. M.; Raulet, D. H.: Rael and H60 ligands of the NKG2D receptor stimulate tumour immunity. Nature 413:165-171, 2001.

1803. Girardi, M.; Oppenheim, D. E.; Steele, C. R.; Lewis, J. M.; Glusac, E.; Filler, R.; Hobby, P.; Sutton, B.; Tigelaar, R. E.; Hayday, A. C.: Regulation of cutaneous malignancy by gamma-delta T cells. Science 294:605-609, 2001.

1804. Groh, V.; Rhinehart, R.; Randolph-Habecker, J.; Topp, M. S.; Riddell, S. R.; Spies, T.: Costimulation of CD8-alpha-beta T cells by NKG2Dvia engagement by MIC induced on virus-infected cells. Nature Immun. 2:255-260, 2001.

1805. Groh, V.; Wu, J.; Yee, C.; Spies, T.: Tumour-derived soluble MIC ligands impair expression of NKG2D and T-cell activation. Nature 419:734-738, 2002.

1806. Li, P.; Morris, D. L.; Willcox, B. E.; Steinle, A.; Spies, T.; Strong, R. K.: Complex structure of the activating immunoreceptor NKG2D and its MHC class I-like ligand MICA. Nature Immun. 2: 443-451, 2001.

1807. Jacquemin, P.; Durviaux, S. M.; Jensen, J.; Godfraind, C.; Gradwohl, G.; Guillemot, F.; Madsen, O. D.; Carmeliet, P.; Dewerchin, M.; Collen, D.; Rousseau, G. G.; Lemaigre, F. P.: Transcription factor hepatocyte nuclear factor 6 regulates pancreatic endocrine cell differentiation and controls expression of the proendocrine gene ngn3. Molec. Cell. Biol. 20: 4445-4454, 2000.

1808. Jacquemin, P.; Lannoy, V. J.; Rousseau, G. G.; Lemaigre, F. P.: OC-2, a novel mammalian member of the ONE-CUT class of homeodomain transcription factors whose function in liver partially overlaps with that of hepatocyte nuclear factor-6. J. Biol. Chem. 274: 2665-2671, 1999.

1809. Lemaigre, F. P.; Durviaux, S. M.; Truong, O.; Lannoy, V. J.; Hsuan, J. J.; Rousseau, G. G.: Hepatocyte nuclear factor 6, a transcription factor that contains a novel type of homeodomain and a single cut domain. Proc. Nat. Acad. Sci. 93: 9460-9464, 1996.

1810. Pierreux, C. E.; Stafford, J.; Demonte, D.; Scott, D. K.; Vandenhaute, J.; O'Brien, R. M.; Granner, D. K.; Rousseau, G. G.; Lemaigre, F. P.: Antiglucocorticoid activity of hepatocyte nuclear factor-6. Proc. Nat. Acad. Sci. 96: 8961-8966, 1999.

1811. Samadani, U.; Costa, R. H.: The transcriptional activator hepatocyte nuclear factor 6 regulates liver gene expression. Molec. Cell. Biol. 16:6273-6284, 1996.

1812. Vaisse, C.; Kim, J.; Espinosa, R., III; Le Beau, M. M.; Stoffel, M.: Pancreatic islet expression studies and polymorphic DNA markers in the genes encoding hepatocyte nuclear factor-3-alpha, -3-beta,-4-gamma, and -6. Diabetes 46: 1364-1367, 1997.

1813. Yamada, K.; Nishida, K.; Hibi, M.; Hirano, T.; Matsuda, Y.: Comparative FISH mapping of Gab1 and Gab2 genes in human, mouse and rat. Cytogenet. Cell Genet. 94: 39-42, 2001.

1814. Kobayashi, H.; Hino, M.; Shimodahira, M.; Iwakura, T.; Ishihara, T.; Ikekubo, K.; Ogawa, Y.; Nakao, K.; Kurahachi, H.: Missense mutation of TRPS1 in a family of tricho-rhino-phalangeal syndrome type III. Am. J. Med. Genet. 107: 26-29, 2002.

1815. Abuladze, N.; Lee, I.; Newman, D.; Hwang, J.; Boorer, K.; Pushkin, A.; Kurtz, I.: Molecular cloning, chromosomal localization, tissue distribution, and functional expression of the human pancreatic sodium bicarbonate cotransporter. J. Biol. Chem. 273: 17689-17695, 1998.

1816. Burnham, C. E.; Amlal, H.; Wang, Z.; Shull, G. E.; Soleimani, M.: Cloning and functional expression of a human kidney Na+:HCO3− cotransporter. J. Biol. Chem. 272: 19111-19114, 1997.

1817. Choi, I.; Romero, M. F.; Khandoudi, N.; Bril, A.; Boron, W. F.: Cloning and characterization of a human electrogenic Na(+)-HCO(3−)cotransporter isoform (hh-NBC). Am. J. Physiol. 276: C576-C584, 1999.

1818. Igarashi, T.; Inatomi, J.; Sekine, T.; Cha, S. H.; Kanai, Y.; Kunimi, M.; Tsukamoto, K.; Satoh, H.; Shimadzu, M.; Tozawa, F.; Mori, T.; Shiobara, M.; Seki, G.; Endou, H.: Mutations in SLC4A4 cause permanent isolated proximal renal tubular acidosis with ocular abnormalities. (Letter) Nature Genet. 23: 264-265, 1999.

1819. Romero, M. F.; Boron, W. F.: Electrogenic Na(+)/HCO(3−) cotransporters: cloning and physiology. Annu. Rev. Physiol. 61: 699-723, 1999.

1820. Soleimani, M.; Burnham, C. E.: Physiologic and molecular aspects of the Na(+):HCO(3-) cotransporter in health and disease processes. Kidney Int. 57: 371-384, 2000.

1821. Usui, T.; et al.; et al.: Pflugers Arch. 438: 458-462, 1999.

1822. Wiley, S. R.; Cassiano, L.; Lofton, T.; Davis-Smith, T.; Winkles, J. A.; Lindner, V.; Liu, H.; Daniel, T. O.; Smith, C. A.; Fanslow, W. C.: A novel TNF receptor family member binds TWEAK and is implicated in angiogenesis. Immunity 15: 837-846, 2001.

1823. Stec, I.; Wright, T. J.; van Ommen, G.-J. B.; de Boer, P. A. J.; van Haeringen, A.; Moorman, A. F. M.; Altherr, M. R.; den Dunnen, J. T.: WHSC1, a 90 kb SET domain-containing gene, expressed in early development and homologous to a Drosophila dysmorphy gene maps in the Wolf-Hirschhorn syndrome critical region and is fused to IgH int(4;14) multiple myeloma. Hum. Molec. Genet. 7: 1071-1082, 1998.

1824. Mao, B.; Wu, W.; Li, Y.; Hoppe, D.; Stannek, P.; Glinka, A.; Niehrs, C.: LDL-receptor-related protein 6 is a receptor for Dickkopf proteins. Nature 411:321-325, 2001.

1825. Hsu, D. R.; Economides, A. N.; Wang, X,; Eimon, P. M.; Harland, R. M.: The Xenopus dorsalizing factor gremlin identifies a novel family of secreted proteins that antagonize BMP activities. Molec. Cell 1: 673-683, 1998.

1826. Topol, L. Z.; Modi, W. S.; Koochekpour, S.; Blair, D. G.: DRM-Gremlin (CKTSF1B1) maps to human chromosome 15 and is highly expressed in adult and fetal brain. Cytogenet. Cell Genet. 89: 79-84, 2000.

1827. Poy, F.; Yaffe, M. B.; Sayos, J.; Saxena, K.; Morra, M.; Sumegi, J.; Cantley, L. C.; Terhorst, C.; Eck, M. J.: Crystal structures of the XLP protein SAP reveal a class of SH2 domains with extended, phosphotyrosine-independent sequence recognition. Molec. Cell 4:555-561, 1999.

1828. Provisor, A. J.; Iacuone, J. J.; Chilcote, R. R.; Neiburger, R. G.; Crussi, F. G.; Baehner, R. L.: Acquired agammaglobulinemia after a life-threatening illness with clinical and laboratory features of infectious mononucleosis in three related male children. New Eng. J. Med. 293: 62-65, 1975.

1829. Purtilo, D. T.: Pathogenesis and phenotypes of an X-linked recessivelymphoproliferative syndrome. Lancet II: 882-885, 1976.

1830. Purtilo, D. T.: X-linked lymphoproliferative syndrome: an immunodeficiency disorder with acquired agammaglobulinemia, fatal infectious mononucleosis, or malignant lymphoma. Arch. Path. Lab. Med. 105: 119-121, 1981.

1831. Purtilo, D. T.; Bhawan, J.; Hutt, L. M.; De Nicola, L.; Szymanski, I.; Yang, J. P. S.; Boto, W.; Naier, R.; Thorley-Lawson, D.: Epstein-Barr virus in the X-linked recessive lymphoproliferative syndrome. Lancet I:798-801, 1978.

1832. Purtilo, D. T.; Cassel, C. K.; Yang, J. P. S.: Fatal infectious mononucleosis in familial lymphohistiocytosis. (Letter) New Eng. J. Med. 201: 736 only, 1974.

1833. Purtilo, D. T.; Cassel, C. K.; Yang, J. P. S.; Harper, R.; Stephenson, S. R.; Landing, B. H.; Vewter, G. F.: X-linked recessive progressive combined variable immunodeficiency (Duncan's disease). Lancet I:935-941, 1975.

1834. Purtilo, D. T.; DeFlorio, D., Jr.; Hutt, L. M.; Bhawan, J.; Yang, J. P. S.; Otto, R. L.; Edwards, W.: Variable phenotypic expression of an X-linked recessive lymphoproliferative syndrome. New Eng. J. Med. 297: 1077-1081, 1977.

1835. Purtilo, D. T.; Grierson, H. L.: Methods of detection of new families with X-linked lymphoproliferative disease. Cancer Genet. Cytogenet. 51: 143-153, 1991.

1836. Purtilo, D. T.; Sakamoto, K.; Barnabei, V.; Seeley, J.; Bechtold, T.; Rogers, G.; Yetz, J.; Harada, S.; the XLP collaborators: Epstein-Barr virus-induced diseases in boys with the X-linked lymphoproliferative syndrome (XLP): update on studies of the registry. Am. J. Med. 73:49-56, 1982.

1837. Purtilo, D. T.; Yang, J. P. S.; Allegra, S.; DeFlorio, D.; Hutt, L. M.; Soltani, M.; Vawter, G. F.: Hematopathology and pathogenesis of the X-linked recessive lymphoproliferative syndrome. Am. J. Med. 62:225-233, 1977.

1838. Sanger, W. G.; Grierson, H. L.; Skare, J.; Wyandt, H.; Pirruccello, S.; Fordyce, R.; Purtilo, D. T.: Partial Xq25 deletion in a family with the X-linked lymphoproliferative disease (XLP). Cancer Genet. Cytogenet. 47: 163-169, 1990.

1839. Sayos, J.; Wu, C.; Morra, M.; Wang, N.; Zhang, X.; Allen, D.; van Schaik, S.; Notarangelo, L.; Gehat, R.; Roncarolo, M. G.; Oettgen, H.; De Vries, J. E.; Aversall, G.; Terhorst, C.: The X-linked lymphoproliferative-disease gene product SAP regulates signals induced through the coreceptor SLAM. Nature 395: 462-469, 1998.

1840. Scher, I.: The CBA/N mouse strain: an experimental model illustrating the influence of the X-chromosome on immunity. Adv. Immun. 33: 1-71, 1982.

1841. Schuster, V.; Kreth, H. W.: X-linked lymphoproliferative disease. In: Ochs, H. D.; Smith, C. I. E.; Puck, J. M. (eds.): Primary Immunodeficiency Diseases: A Molecular and Genetic Approach. New York: Oxford University Press 1999. Pp. 222-232.

1842. Seemayer, T. A.; Gross, T. G.; Egeler, R. M.; Pirruccello, S. J.; Davis, D. J.; Kelly, C. M.; Okano, M.; Lanyi, A.; Sumegi, J.: X-linked lymphoproliferative disease: twenty-five years after the discovery. Pediat. Res. 38: 471-478, 1995.

1843. Skare, J.; Grierson, H.; Wyandt, H.; Sanger, W.; Milunsky, J.; Purtilo, D.; Sullivan, J.; Milunsky, A.: Genetics of the X-linked lymphoproliferative syndrome. (Abstract) Am. J. Hum. Genet. 45 (suppl.):A161 only, 1989.

1844. Skare, J.; Madan, S.; Glaser, J.; Purtilo, D.; Nitowsky, H.; Pulijaal, V.; Milunsky, A.: First prenatal diagnosis of X-linked lymphoproliferative disease. Am. J. Med. Genet. 44: 79-81, 1992.

1845. Skare, J.; Milunsky, A.; Byron, K.; Sullivan, J.: The mutation causing X-linked lymphoproliferative syndrome lies in Xq26. (Abstract) Am. J. Hum. Genet. 41: A185 only, 1987.

1846. Skare, J.; Wu, B.-L.; Madan, S.; Pulijaal, V.; Purtilo, D.; Haber, D.; Nelson, D.; Sylla, B.; Grierson, H.; Nitowsky, H.; Glaser, J.; Wissink, J.; White, B.; Holden, J.; Housman, D.; Lenoir, G.; Wyandt, H.; Milunsky, A.: Characterization of three overlapping deletions causing X-linked lymphoproliferative disease. Genomics 16: 254-255, 1993.

1847. Skare, J. C.; Grierson, H. L.; Sullivan, J. L.; Nussbaum, R. L.; Purtilo, D. T.; Sylla, B. S.; Lenoir, G. M.; Reilly, D. S.; White, B. N.; Milunsky, A.: Linkage analysis of seven kindreds with the X-linked lymphoproliferative syndrome (XLP) confirms that the XLPlocus is near DXS42 and DXS37. Hum. Genet. 82: 354-358, 1989.

1848. Skare, J. C.; Milunsky, A.; Byron, K. S.; Sullivan, J. L.: Mapping the X-linked lymphoproliferative syndrome. Proc. Nat. Acad. Sci. 84:2015-2018, 1987.

1849. Skare, J. C.; Sullivan, J. L.; Milunsky, A.: Mapping the mutation causing the X-linked lymphoproliferative syndrome in relation to restriction fragment length polymorphisms on Xq. Hum. Genet. 82: 349-353, 1989.

1850. Steinherz, R.; Levy, Y.; Litwin, A.; Nitzan, M.; Friedman, E.; Levin, S.: X-linked lymphoproliferative syndrome: a new kindred with variable phenotypic expression. Am. J. Dis. Child. 139: 191-193, 1985.

1851. Maho, A.; Bensimon, A.; Vassart, G.; Parmentier, M.: Mapping of the CCXCR1, CX3CR1, CCBP2 and CCR9 genes to the CCR cluster within the 3p21.3 region of the human genome. Cytogenet. Cell Genet. 87:265-268, 1999.

1852. Roberts, A. I.; Lee, L.; Schwarz, E.; Groh, V.; Spies, T.; Ebert, E. C.; Jabri, B.: Cutting edge: NKG2D receptors induced by IL-15 costimulate CD28-negative effector CTL in the tissue microenvironment. J. Immun. 167: 5527-5530, 2001.

1853. Ware, R. E.; Howard, T. A.; Kamitani, T.; Chang, H.-M.; Yeh, E. T. H.; Seldin, M. F.: Chromosomal assignment of genes involved in glycosylphosphatidylinositol anchor biosynthesis: implications for the pathogenesis of paroxysmal nocturnal hemoglobinuria. Blood 83:3753-3757, 1994.

1854. Watanabe, R.; Inoue, N.; Westfall, B.; Taron, C. H.; Orlean, P.; Takeda, J.; Kinoshita, T.: The first step of glycosylphosphatidylinositol biosynthesis is mediated by a complex of PIG-A, PIG-H, PIG-C and GPI1. EMBO J. 17: 877-885, 1998.

1855. Watanabe, R.; Kinoshita, T.; Masaki, R.; Yamamoto, A.; Takeda, J.; Inoue, N.: PIG-A and PIG-H, which participate in glycosylphosphatidylinositol anchor biosynthesis, form a protein complex in the endoplasmic reticulum. J. Biol. Chem. 271: 26868-26875, 1996.

1856. Bishop, K. M.; Goudreau, G.; O'Leary, D. D. M.: Regulation of area identity in the mammalian neocortex by Emx2 and Pax6. Science 288:344-349, 2000.

1857. Janz, R.; Sudhof, T. C.; Hammer, R. E.; Unni, V.; Siegelbaum, S. A.; Bolshakov, V. Y.: Essential roles in synaptic plasticity for synaptogyrin I and synaptophysin I. Neuron 24: 687-700, 1999.

1858. McMahon, H. T.; Bolshakov, V. Y.; Janz, R.; Hammer, R. E.; Siegelbaum, S. A.; Sudhof, T. C.: Synaptophysin, a major synaptic vesicle protein, is not essential for neurotransmitter release. Proc. Nat. Acad. Sci. 93:4760-4764, 1996.

1859. Geppert, M.; Khvotchev, M.; Krasnoperov, V.; Goda, Y.; Missler, M.; Hammer, R. E.; Ichtchenko, K.; Petrenko, A. G.; Sudhof, T. C.: Neurexin I-alpha is a major alpha-I atrotoxin receptor that cooperatesin alpha-I atrotoxin action. J. Biol. Chem. 273: 1705-1710, 1998.

1860. Ichtchenko, K.; Hata, Y.; Nguyen, T.; Ullrich, B.; Missler, M.; Moomaw, C.; Sudhof, T. C.: Neuroligin 1: a splice site-specific ligand for beta-neurexins. Cell 81: 435-443, 1995.

1861. Kleiderlein, J. J.; Nisson, P. E.; Jessee, J.; Li, W.-B.; Becker, K. G.; Derby, M. L.; Ross, C. A.; Margolis, R. L.: CCG repeats in cDNAs from human brain. Hum. Genet. 103: 666-673, 1998. Note: Erratum: Hum. Genet. 104: 113 only, 1999.

1862. Margolis, R.: Personal Communication. Baltimore, Md. Mar. 29, 2000.

1863. Missler, M.; Sudhof, T. C.: Neurexins: three genes and 1001 products. Trends Genet. 14: 20-26, 1998.

1864. Ikeshima, H.; Imai, S.; Shimoda, K.; Hata, J.; Takano, T.: Expression of a MADS box gene, MEF2D, in neurons of the mouse central nervous system: implication of its binary function in myogenic and neurogenic cell lineages. Neurosci. Lett. 200: 117-120, 1995.

1865. Shearman, L. P.; Zylka, M. J.; Weaver, D. R.; Kolakowski, L. F. Jr.; Reppert, S. M.: Two period homologs: circadian expression and photic regulation in the suprachiasmatic nuclei. Neuron 19: 1261-1269, 1997.

1866. Toh, K. L.; Jones, C. R.; He, Y.; Eide, E. J.; Hinz, W. A.; Virshup, D. M.; Ptacek, L. J.; Fu, Y.-H.: An hPer2 phosphorylation site mutation in familial advanced sleep phase syndrome. Science 291: 1040-1043, 2001.

1867. Chien, W.; Pei, L.: A novel binding factor facilitates nuclear translocation and transcriptional activation function of the pituitary tumor-transforming gene product. J. Biol. Chem. 275: 19422-19427, 2000.

1868. Yaspo, M.-L.; Aaltonen, J.; Horelli-Kuitunen, N.; Peltonen, L.; Lehrach, H.: Cloning of a novel human putative type Ia integral membrane protein mapping to 21q22.3. Genomics 49: 133-136, 1998.

1869. Yaspo, M.-L.; Gellen, L.; Mott, R.; Korn, B.; Nizetic, D.; Poustka, A. M.; Lehrach, H.: Model for a transcript map of human chromosome 21: isolation of new coding sequences from exon and enriched cDNA libraries. Hum. Molec. Genet. 4: 1291-1304, 1995.

1870. Liao, C.; Wang, X. Y.; Wei, H. Q.; Li, S. Q.; Merghoub, T.; Pandolfi, P. P.; Wolgemuth, D. J.: Altered myelopoiesis and the development of acute myeloid leukemia in transgenic mice overexpressing cyclin A1. Proc. Nat. Acad. Sci. 98: 6853-6858, 2001.

1871. Liu, D.; Matzuk, M. M.; Sung, W. K.; Guo, Q.; Wang, P.; Wolgemuth, D. J.: Cyclin A1 is required for meiosis in the male mouse. Nature Genet. 20: 377-380, 1998.

1872. Muller, C.; Yang, R.; Beck-von-Peccoz, L.; Idos, G.; Verbeek, W.; Koeffler, H. P.: Cloning of the cyclin A1 genomic structure and characterization of the promoter region: GC boxes are essential for cell cycle-regulated transcription of the cyclin A1 gene. J. Biol. Chem. 274: 11220-11228, 1999.

1873. Dolganov, G. M.; Maser, R. S.; Novikov, A.; Tosto, L.; Chong, S.; Bressan, D. A.; Petrini, J. H. J.: Human Rad50 is physically associated with human Mre11: identification of a conserved multiprotein complex implicated in recombinational DNA repair. Molec. Cell Biol. 16:4832-4841, 1996.

1874. Hopfner, K.-P.; Craig, L.; Moncalian, G.; Zinkel, R. A.; Usui, T.; Owen, B. A. L.; Karcher, A.; Henderson, B.; Bodmer, J.-L.; McMurray, C. T.; Carney, J. P.; Petrini, J. H. J.; Tainer, J. A.: The Rad50 zinc-hook is a structure joining Mre11 complexes in DNA recombination and repair. Nature 418: 562-566, 2002.

1875. Luo, G.; Yao, M. S.; Bender, C. F.; Mills, M.; Bladl, A. R.; Bradley, A.; Petrini, J. H. J.: Disruption of mRad50 causes embryonic stem cell lethality, abnormal embryonic development, and sensitivity to ionizing radiation. Proc. Nat. Acad. Sci. 96: 7376-7381, 1999.

1876. Trujillo, K. M.; Yuan, S.-S. F.; Lee, E. Y.-H. P.; Sung, P.: Nuclease activities in a complex of human recombination and DNA repair factors Rad50, Mre11, and p95. J. Biol. Chem. 273: 21447-21450, 1998.

1877. Deiss, L. P.; Feinstein, E.; Berissi, H.; Cohen, O.; Kimchi, A.: Identification of a novel serine/threonine kinase and a novel 15-kD protein as potential mediators of the gamma interferon-induced cell death. Genes Dev. 9: 15-30, 1995.

1878. Feinstein, E.; Druck, T.; Kastury, K.; Berissi, H.; Goodart, S. A.; Overhauser, J.; Kimchi, A.; Huebner, K.: Assignment of DAP1 and DAPK: genes that positively mediate programmed cell death triggered by IFN-gamma—to chromosome regions 5p12.2 (sic) and 9q34.1, respectively. Genomics 29:305-307, 1995.

1879. Kim, D.-H.; Iijima, H.; Goto, K.; Sakai, J.; Ishii, H.; Kim, H.-J.; Suzuki, H.; Kondo, H.; Saeki, S.; Yamamoto, T.: Human apolipoprotein E receptor 2: a novel lipoprotein receptor of the low density lipoprotein receptor family predominantly expressed in brain. J. Biol. Chem. 271: 8373-8380, 1996.

1880. Kim, D.-H.; Magoori, K.; Inoue, T. R.; Mao, C. C.; Kim, H.-J.; Suzuki, H.; Fujita, T.; Endo, Y.; Saeki, S.; Yamamoto, T. T.: Exon/intron organization, chromosome localization, alternative splicing, and transcription units of the human apolipoprotein E receptor 2 gene. J. Biol. Chem. 272:8498-8504, 1997.

1881. Campuzano, V.; Montermini, L.; Molto, M. D.; Pianese, L.; Cossee, M.; Cavalcanti, F.; Monros, E.; Rodius, F.; Duclos, F.; Monticelli, A.; Zara, F.; Canizares, J.; Koutnikova, H.; Bidichandani, S. I.; Gellera, C.; Brice, A.; Trouillas, P.; De Michele, G.; Filla, A.; De Frutos, R.; Palau, F.; Patel, P. I.; Di Donato, S.; Mandel, J.-L.; Cocozza, S.; Koenig, M.; Pandolfo, M.: Friedreich's ataxia: autosomal recessive disease caused by an intronic GAA triplet repeat expansion. Science 271: 1423-1427, 1996.

1882. Ilyin, G. P.; Rialland, M.; Pigeon, C.; Guguen-Guillouzo, C.: cDNA cloning and expression analysis of new members of the mammalian F-box protein family. Genomics 67: 40-47, 2000.

1883. Andersson, P.; McGuire, J.; Rubio, C.; Gradin, K.; Whitelaw, M. L.; Pettersson, S.; Hanberg, A.; Poellinger, L.: A constitutively active dioxin/aryl hydrocarbon receptor induces stomach tumors. Proc. Nat. Acad. Sci. 99: 9990-9995, 2002.

1884. Ema, M.; Matsushita, N.; Sogawa, K.; Ariyama, T.; Inazawa, J.; Nemoto, T.; Ota, M.; Oshimura, M.; Fujii-Kuriyama, Y.: Human arylhydrocarbon receptor: functional expression and chromosomal assignment to 7p21. J. Biochem. 116: 845-851, 1994.

1885. Le Beau, M. M.; Carver, L. A.; Espinosa, R., III; Schmidt, J. V.; Bradfield, C. A.: Chromosomal localization of the human AHR locusen coding the structural gene for the Ah receptor to 7p21-p15. Cytogenet. Cell Genet. 66: 172-176, 1994.

1886. Micka, J.; Milatovich, A.; Menon, A.; Grabowski, G. A.; Puga, A.; Nebert, D. W.: Human Ah receptor (AHR) gene: localization to 7p15 and suggestive correlation of polymorphism with CYP1A1 inducibility. Pharmacogenetics 7:95-101, 1997.

1887. Shimizu, Y.; Nakatsuru, Y.; Ichinose, M.; Takahashi, Y.; Kume, H.; Mimura, J.; Fujii-Kuriyama, Y.; Ishikawa, T.: Benzo[a]pyrenecarcinogenicity is lost in mice lacking the aryl hydrocarbon receptor. Proc. Nat. Acad. Sci. 97: 779-782, 2000.

1888. Breitbart, R. E.; Liang, C.; Smoot, L. B.; Laheru, D. A.; Mahdavi, V.; Nadal-Ginard, B.: A fourth human MEF2 transcription factor, hMEF2D, is an early marker of the myogenic lineage. Development 118: 1095-1106, 1993.

1889. Hobson, G. M.; Krahe, R.; Garcia, E.; Siciliano, M. J.; Funanage, V. L.: Regional chromosomal assignments for four members of the MADS domain transcription enhancer factor 2 (MEF2) gene family to human chromosomes 15q26, 19p12, 5q14, and 1q12-q23. Genomics 29: 704-711, 1995.

1890. Mao, Z.; Bonni, A.; Xia, F.; Nadal-Vicans, M.; Greenberg, M. E.: Neuronal activity-dependent cell survival mediated by transcription factor MEF2. Science 286: 785-790, 1999.

1891. Martin, J. F.; Miano, J. M.; Hustad, C. M.; Copeland, N. G.; Jenkins, N. A.; Olson, E. N.: A Mef2 gene that generates a muscle-specific isoform via alternative mRNA splicing. Molec. Cell. Biol. 14: 1647-1656, 1994.

1892. Molkentin, J. D.; Black, B. L.; Martin, J. F.; Olson, E. N.: Cooperative activation of muscle gene expression by MEF2 and myogenic bHLH proteins. Cell 83:1125-1136, 1995.

1893. Naya, F. J.; Black, B. L.; Wu, H.; Bassel-Duby, R.; Richardson, J. A.; Hill, J. A.; Olson, E. N.: Mitochondrial deficiency and cardiac sudden death in mice lacking the MEF2A transcription factor. Nature Med. 15 Oct., 2002. Note: Advance Electronic Publication.

1894. Pollock, R.; Treisman, R.: Human SRF-related proteins: DNA-binding properties and potential regulatory targets. Genes Dev. 5: 2327-2341, 1991.

1895. Suzuki, E.; Lowry, J.; Sonoda, G.; Testa, J. R.; Walsh, K.: Structures and chromosome locations of the human MEF2A gene and a pseudo gene MEF2AP. Cytogenet. Cell Genet. 73: 244-249, 1996.

1896. Yu, Y.-T.; Breitbart, R. E.; Smoot, L. B.; Lee, Y.; Mahdavi, V.; Nadal-Ginard, B.: Human myocyte-specific enhancer factor 2 comprises a group of tissue-restricted MADS box transcription factors. Genes Dev. 6: 1783-1798, 1992.

1897. Krainc, D.; Haas, M.; Ward, D. C.; Lipton, S. A.; Bruns, G.; Leifer, D.: Assignment of human myocyte-specific enhancer binding factor 2C (hMEF2C) to human chromosome 5q14 and evidence that MEF2C is evolutionarily-conserved. Genomics 29: 809-811, 1995.

1898. Leifer, D.; Krainc, D.; Yu, Y.-T.; McDermott, J.; Breitbart, R. E.; Heng, J.; Neve, R. L.; Kosofsky, B.; Nadal-Ginard, B.; Lipton, S. A.: MEF2C, a MADS/MEF2-family transcription factor expressed in a laminar distribution in cerebral cortex. Proc. Nat. Acad. Sci. 90:1546-1550, 1993.

1899. Boie, Y.; Rushmore, T. H.; Darmon-Goodwin, A.; Grygorczyk, R.; Slipetz, D. M.; Metters, K. M.; Abramovitz, M.: Cloning and expression of a cDNA for the human prostanoid IP receptor. J. Biol. Chem. 269:12173-12178, 1994.

1900. Ishikawa, T.; Tamai, Y.; Rochelle, J. M.; Hirata, M.; Namba, T.; Sugimoto, Y.; Ichikawa, A.; Narumiya, S.; Taketo, M. M.; Seldin, M. F.: Mapping of the genes encod- 1900. ing mouse prostaglandin D, E, and F and prostacyclin receptors. Genomics 32: 285-288, 1996.

1901. Murata, T.; Ushikubi, F.; Matsuoka, T.; Hirata, M.; Yamasaki, A.; Sugimoto, Y.; Ichikawa, A.; Aze, Y.; Tanaka, T.; Yoshida, N.; Ueno, A.; Oh-ishi, S.; Narumiya, S.: Altered pain perception and inflammatory response in mice lacking prostacyclin receptor. Nature 388: 678-682, 1997.

1902. Ogawa, Y.; Tanaka, I.; Inoue, M.; Yoshitake, Y.; Isse, N.; Nakagawa, O.; Usui, T.; Itoh, H.; Yoshimasa, T.; Narumiya, S.; Nakao, K.: Structural organization and chromosomal assignment of the human prostacyclin receptor gene. Genomics 27: 142-148, 1995.

1903. Hoffman, I.; Balling, R.: Chromosomal localization of the murine c adherin-11. Mammalian Genome 6: 304 only, 1995.

1904. Okazaki, M.; Takeshita, S.; Kawai, S.; Kikuno, R.; Tsujimura, A.; Kudo, A.; Amann, E.: Molecular cloning and characterization of OB-cadherin, a new member of cadherin family expressed in osteoblasts. J. Biol. Chem. 269: 12092-12098, 1994.

1905. Tanihara, H.; Sano, K.; Heimark, R. L.; St. John, T.; Suzuki, S.: Cloning of five human cadherins clarifies characteristic features of cadherin extracellular domain and provides further evidence for two structurally different types of cadherin. Cell Adhes. Commun. 2:15-26, 1994.

1906. Flanagan, J. R.; Becker, K. G.; Ennist, D. L.; Gleason, S. L.; Driggers, P. H.; Levi, B.-Z.; Appella, E.; Ozato, K.: Cloning of a negative transcription factor that binds to the upstream conserved region of Moloney murine leukemia virus. Molec. Cell. Biol. 12:38-44, 1992.

1907. Hariharan, N.; Kelley, D. E.; Perry, R. P.: Delta, a transcription factor that binds to downstream elements in several polymerase II promoters, is a functionally versatile zinc finger protein. Proc. Nat. Acad. Sci. 88: 9799-9803, 1991.

1908. Oei, S. L.; Shi, Y.: Transcription factor Yin Yang 1 stimulates poly(ADP-ribosyl)ation and DNA repair. Biochem. Biophys. Res. Commun. 284:450-454, 2001.

1909. Park, K.; Atchison, M. L.: Isolation of a candidate repressor/activator, NF-E1 (YY-1, delta), that binds to the immunoglobulin kappa 3-prime enhancer and the immunoglobulin heavy-chain micro-El site. Proc. Nat. Acad. Sci. 88: 9804-9808, 1991.

1910. Shi, Y.; Seto, E.; Chang, L.-S.; Shenk, T.: Transcriptional repression by YY1, a human GLI-Kruppel-related protein, and relief of repression by adenovirus E1A protein. Cell 67: 377-388, 1991.

1911. Yao, Y.-L.; Dupont, B. R.; Ghosh, S.; Fang, Y.; Leach, R. J.; Seto, E.: Cloning, chromosomal localization and promoter analysis of the human transcription factor YY1. Nucleic Acids Res. 26: 3776-3783, 1998.

1912. Zhu, W.; Lossie, A. C.; Camper, S. A.; Gumucio, D. L.: Chromosomal localization of the transcription factor YY1 in the mouse and human. Mammalian Genome 5: 234-236, 1994.

1913. Kikuno, R.; Nagase, T.; Ishikawa, K.; Hirosawa, M.; Miyajima, N.; Tanaka, A.; Kotani, H.; Nomura, N.; Ohara, O.: Prediction of the coding sequences of unidentified human genes. XIV. The complete sequences of 100 new cDNA clones from brain which code for large proteins in vitro. DNA Res. 6: 197-205, 1999.

1914. Gao, X.; Copeland, N. G.; Gilbert, D. J.; Jenkins, N. A.; Gridley, T.: Assignment of the murine Notch2 and Notch3 genes to chromosomes 3 and 17. Genomics 49: 160-161, 1998.

1915. Larsson, C.; Lardelli, M.; White, I.; Lendahl, U.: The human NOTCH1, 2, and 3 genes are located at chromosome positions 9q34, 1p13-p11, and 19p13.2-p13.1 in regions of neoplasia-associated translocation. Genomics 24:253-258, 1994.

1916. Eudy, J. D.; Yao, S.; Weston, M. D.; Ma-Edmonds, M.; Talmadge, C. B.; Cheng, J. J.; Kimberling, W. J.; Sumegi, J.: Isolation of a gene encoding a novel member of the nuclear receptor superfamily from the critical region of Usher syndrome type IIa at 1q41. Genomics 50:382-384, 1998.

1917. Greschik, H.; Wurtz, J.-M.; Sanglier, S.; Bourguet, W.; van Dorsselaer, A.; Moras, D.; Renaud, J.-P.: Structural and functional evidence for ligand-independent transcriptional activation by the estrogen-related receptor 3. Molec. Cell 9: 303-313, 2002.

1918. Bertilsson, G.; Heidrich, J.; Svensson, K.; Asman, M.; Jendeberg, L.; Sydow-Backman, M.; Ohlsson, R.; Postlind, H.; Blomquist, P.; Berkenstam, A.: Identification of a human nuclear receptor defines a new signaling pathway for CYP3A induction. Proc. Nat. Acad. Sci. 95: 12208-12213, 1998.

1919. Blumberg, B.; Sabbagh, W., Jr.; Juguilon, H.; Bolado, J., Jr.; van Meter, C. M.; Ong, E. S.; Evans, R. M.: SXR, a novel steroid and xenobiotic-sensing nuclear receptor. Genes Dev. 12: 3195-3205, 1998.

1920. Watkins, R. E.; Wisely, G. B.; Moore, L. B.; Collins, J. L.; Lambert, M. H.; Williams, S. P.; Willson, T. M.; Kliewer, S. A.; Redinbo, M. R.: The human nuclear xenobiotic receptor PXR: structural determinants of directed promiscuity. Science 292: 2329-2333, 2001.

1921. Andre, E.; Conquet, F.; Steinmayr, M.; Stratton, S. C.; Porciatti, V.; Becker-Andre, M.: Disruption of retinoid-related orphan receptor beta changes circadian behavior, causes retinal degeneration and leads to vacillans phenotype in mice. EMBO J. 17: 3867-3877, 1998.

1922. Paravicini, G.; Steinmayr, M.; Andre, E.; Becker-Andre, M.: The metastasis suppressor candidate nucleotide diphosphate kinase NM23 specifically interacts with members of the ROR/RZR nuclear orphan receptor subfamily. Biochem. Biophys. Res. Commun. 227: 82-87, 1996.

1923. Sirlin, J. L.: Vacillans, a neurological mutant in the house mouse linked with brown. J. Genet. 54: 42-48, 1956.

1924. Fritzler, M. J.; Lung, C.-C.; Hamel, J. C.; Griffith, K. J.; Chan, E. K. L.: Molecular characterization of golgin-245, a novel Golgi complex protein containing a gran in signature. J. Biol. Chem. 270:31262-31268, 1995.

1925. Heard, D. J.; Norby, P. L.; Holloway, J.; Vissing, H.: Human ERR-gamma, a third member of the estrogen receptor-related receptor (ERR) subfamily of orphan nuclear receptors: tissue-specific isoforms are expressed during development in the adult. Molec. Endocr. 14: 382-392, 2000.

1926. Hong, H.; Yang, L.; Stallcup, M. R.: Hormone-independent transcriptional activation and coactivator binding by novel orphan nuclear receptor ERR3. J. Biol. Chem. 274: 22618-22626, 1999.

1927. Kooy, J.; Toh, B.-H.; Pettitt, J. M.; Erlich, R.; Gleeson, P. A.: Human autoantibodies as reagents to conserved Golgi components: characterization of a peripheral, 230-kDa compartment-specific Golgi protein. J. Biol. Chem. 267: 20255-20263, 1992.

1928. Zheng, B.; Chen, D.; Farquhar, M. G.: MIR16, a putative membrane glycerophosphodiester phosphodiesterase, interacts with RGS16. Proc. Nat. Acad. Sci. 97: 3999-4004, 2000.

1929. Bergelson, J. M.; Cunningham, J. A.; Droguett, G.; Kurt-Jones, E. A.; Krithivas, A.; Hong, J. S.; Horwitz, M. S.; Crowell, R. L.; Finberg, R. W.: Isolation of a common receptor for coxsackie B viruses and adenoviruses 2 and 5. Science 275: 1320-1323, 1997.

1930. Bowles, K. R.; Gibson, J.; Wu, J.; Shaffer, L. G.; Towbin, J. A.; Bowles, N. E.: Genomic organization and chromosomal localization of the human Coxsackie virus Badeno virus receptor gene. Hum. Genet. 105:354-359, 1999.

1931. Carson, S. D.; Chapman, N. N.; Tracy, S. M.: Purification of the putative coxsackie virus B receptor from HeLa cells. Biochem. Biophys. Res. Commun. 233: 325-328, 1997.

1932. Griffin, L. D.; Kearney, D.; Ni, J.; Jaffe, R.; Fricker, F. J.; Webber, S.; Demmler, G.; Gelb, B. D.; Towbin, J. A.: Analysis of formalin-fixed and frozen myocardial autopsy samples for viral genome in childhood myocarditis and dilated cardiomyopathy with endocardial fibroelastosis using polymerase chain reaction (PCR). Cardiovasc. Path. 4: 3-11, 1995.

1933. Martin, A. B.; Webber, S.; Fricker, F. J.; Jaffe, R.; Demmler, G.; Kearney, D.; Zhang, Y.-H.; Bodurtha, J.; Gelb, B.; Ni, J.; Bricker, J. T.; Towbin, J. A.: Acute myocarditis: rapid diagnosis by PCR in children. Circulation 90: 330-339, 1994.

1934. Pauschinger, M.; Bowles, N. E.; Fuentes-Garcia, F. J.; Pham, V.; Kuhl, U.; Schwimmbeck, P. L.; Schultheiss, H.-P.; Towbin, J. A.: Detection of adenoviral genome in the myocardium of adult patients with idiopathic left ventricular dysfunction. Circulation 99: 1348-1354, 1999.

1935. Tomko, R. P.; Xu, R.; Philipson, L.: HCAR and MCAR: the human and mouse receptors for subgroup C adenoviruses and group B coxsackie viruses. Proc. Nat. Acad. Sci. 94: 3352-3356, 1997.

1936. Zhang, J.; Kuehl, P.; Green, E. D.; Touchman, J. W.; Watkins, P. B.; Daly, A.; Hall, S. D.; Maurel, P.; Relling, M.; Brimer, C.; Yasuda, K.; Wrighton, S. A.; Hancock, M.; Kim, R. B.; Strom, S.; Thummel, K.; Russell, C. G.; Hudson, J. R., Jr.; Schuetz, E. G.; Boguski, M. S.: The human pregnane X receptor: genomic structure and identification and functional characterization of natural allelic variants. Pharmacogenetics 11:555-572, 2001.

1937. Su, L.-K.; Qi, Y.: Characterization of human MAPRE genes and their proteins. Genomics 71: 143-149, 2001.

1938. Wicki, R.; Marenholz, I.; Mischke, D.; Schafer, B. W.; Heizmann, C. W.: Characterization of the human S100A12 (calgranulin C, p6, CAAF1, CGRP) gene, a new member of the S100 gene cluster on chromosome 1q21. Cell Calcium 20: 459-464, 1996.

1939. Brandt, S.; Jentsch, T. J.: ClC-6 and ClC-7 are two novel broadly expressed members of the CLC chloride channel family. FEBS Lett. 377:15-20, 1995.

1940. Eggermont, J.; Buyse, G.; Voets, T.; Tytgat, J.; De Smedt, H.; Droogmans, G.: Alternative splicing of ClC-6 (a member of the ClC chloride-channel family) transcripts generates three truncated isoforms one of which, ClC-6c, is kidney-specific. Biochem. J. 325: 269-276, 1997.

1941. Nagase, T.; Ishikawa, K.; Suyama, M.; Kikuno, R.; Hirosawa, M.; Miyajima, N.; Tanaka, A.; Kotani, H.; Nomura, N.; Ohara, O.: Prediction of the coding sequences of unidentified human genes. XIII. The complete sequences of 100 new cDNA clones from brain which code for large proteins in vitro. DNA Res. 6: 63-70, 1999.

1942. Arico, M.; Imashuku, S.; Clementi, R.; Hibi, S.; Teramura, T.; Danesino, C.; Haber, D. A.; Nichols, K. E.: Hemophagocytic lymphohistiocytosis due to germline mutations in SH2D1A, the X-linked lymphoproliferative disease gene. Blood 97: 1131-1133, 2001.

1943. Arkwright, P. D.; Makin, G.; Will, A. M.; Ayres, M.; Gokhale, D. A.; Fergusson, W. D.; Taylor, G. M.: X linked lymphoproliferative disease in a United Kingdom family. Arch. Dis. Child. 79: 52-55, 1998.

1944. Bar, R. S.; DeLor, C. J.; Clausen, K. P.; Hurtubise, P.; Henle, W.; Hewetson, J. F.: Fatal infectious mononucleosis in a family. New Eng. J. Med. 290: 363-367, 1974.

1945. Benoit, L.; Wang, X.; Pabst, H. F.; Dutz, J.; Tan, R.: Cutting edge: defective NK cell activation in X-linked lymphoproliferative disease. J. Immun. 165: 3549-3553, 2000.

1946. Brandau, O.; Schuster, V.; Weiss, M.; Hellebrand, H.; Fink, F. M.; Kreczy, A.; Friedrich, W.; Strahm, B.; Niemeyer, C.; Belohradsky, B. H.; Meindl, A.: Epstein-Barr virus-negative boys with non-Hodgkin lymphoma are mutated in the SH2D1A gene, as are patients with X-linked lymphoproliferative disease (XLP). Hum. Molec. Genet. 8: 2407-2413, 1999.

1947. Coffey, A. J.; Brooksbank, R. A.; Brandau, O.; Oohashi, T.; Howell, G. R.; Bye, J. M.; Cahn, A. P.; Durham, J.; Heath, P.; Wray, P.; Pavitt, R.; Wilkinson, J.; and 31 others: Host response to EBV infection in X-linked lymphoproliferative disease results from mutations in an SH2-domain encoding gene. Nature Genet. 20: 129-135, 1998.

1948. Czar, M. J.; Kersh, E. N.; Mijares, L. A.; Lanier, G.; Lewis, J.; Yap, G.; Chen, A.; Sher, A.; Duckett, C. S.; Ahmed, R.; Schwartzberg, P. L.: Altered lymphocyte responses and cytokine production in mice deficient in the X-linked lymphoproliferative disease gene SH2D1A/ DSHP/SAP. Proc. Nat. Acad. Sci. 98: 7449-7454, 2001.

1949. Dutz, J. P.; Benoit, L.; Wang, X.; Demetrick, D. J.; Junker, A.; de Sa, D.; Tan, R.: Lymphocytic vasculitis in X-linked lymphoproliferative disease. Blood 97: 95-100, 2001.

1950. Grierson, H. L.; Skare, J.; Church, J.; Silberman, T.; Davis, J. R.; Kobrinsky, N.; McGregor, R.; Israels, S.; McCarty, J.; Andrews, L. G.; Blecha, T.; Erdman, S.; Obringer, A.; Scharnhorst, D.; Purtilo, D. T.: Evaluation of families wherein a single male manifests a phenotype of X-linked lymphoproliferative disease (XLP). Am. J. Med. Genet. 47:458-463, 1993.

1951. Hambleton, G.; Cottom, D. G.: Familial lymphoma. Proc. Roy. Soc. Med. 62: 1095 only, 1969.

1952. Hamilton, J. K.; Paquin, L. A.; Sullivan, J. L.; Maurer, H. S.; Cruzi, F. G.; Provisor, A. J.; Steuber, C. P.; Hawkins, E.; Yawn, D.; Cornet, J.; Clausen, K.; Finkelstein, G. Z.; Landing, B.; Grunnet, M.; Purtilo, D. T.: X-linked lymphoproliferative syndrome registry report. J. Pediat. 96: 669-673, 1980.

1953. Harris, A.; Docherty, Z.: X-linked lymphoproliferative disease: a karyotype analysis. Cytogenet. Cell Genet. 47: 92-94, 1988.

1954. Harris, A.; Lenoir, G. M.; Lankester, S. A.: X-linked lymphoproliferative disease: linkage studies using DNA probes. Clin. Genet. 33: 162-168, 1988.

1955. Hayoz, D.; Lenoir, G. M.; Nicole, A.; Pugin, P.; Regamey, C.: X-linked lymphoproliferative syndrome: identification of a large family in Switzerland. Am. J. Med. 84: 529-534, 1988.

1956. Klein, G.; Klein, E.: Sinking surveillance's flagship. Nature 395:441-445, 1998.

1957. Levine, P. H.; Kamaraju, L. S.; Connelly, R. R.; Berard, C. W.; Dorfman, R. F.; Magrath, I.; Easton, J. M.: The American Burkitt's Lymphoma Registry: eight years' experience. Cancer 49: 1016-1022, 1982.

1958. Loeffel, S.; Chang, C.-H.; Heyn, R.; Harada, S.; Lipscomb, H.; Sinangil, F.; Volsky, D. J.; McClain, K.; Ochs, H.; Purtilo, D. T.: Necrotizing lymphoid vasculitis in X-linked lymphoproliferative syndrome. Arch. Path. Lab. Med. 109: 546-550, 1985.

1959. Lyon, M. F.; Loutit, J. F.: X-linked factor in acquired immunodeficiency syndrome?. (Letter) Lancet I: 768 only, 1983.

1960. Mulley, J. C.; Turner, A. M.; Gedeon, A. K.; Berdoukas, V. A.; Huang, T. H. M.; Ledbetter, D. H.; Grierson, H.; Purtilo, D. T.: X-linked lymphoproliferative disease: prenatal detection of an unaffected histocompatible male. Clin. Genet. 42: 76-79, 1992.

1961. Dai, K.-S.; Liew, C.-C.: A novel human striated muscle RING zinc finger protein, SMRZ, interacts with SMT3b via its RING domain. J. Biol. Chem. 276: 23992-23999, 2001.

1962. Zheng, B.; Albrecht, U.; Kaasik, K.; Sage, M.; Lu, W.; Vaishnav, S.; Li, Q.; Sun, Z. S.; Eichele, G.; Bradley, A.; Lee, C. C.: Nonredundant roles of the mPer1 and mPer2 genes in the mammalian circadian clock. Cell 105:683-694, 2001.

1963. Rulten, S.; Thorpe, J.; Kay, J.: Identification of eukaryotic parvulin homologues: a new subfamily of peptidylprolyl cis-trans isomerases. Biochem. Biophys. Res. Commun. 259: 557-562, 1999.

1964. Ichinose, H.; Ohye, T.; Suzuki, T.; Sumi-Ichinose, C.; Nomura, T.; Hagino, Y.; Nagatsu, T.: Molecular cloning of the human Nurr1 gene: characterization of the human gene and cDNAs. Gene 230: 233-239, 1999.

1965. Law, S. W.; Conneely, O. M.; DeMayo, F. J.; O'Malley, B. W.: Identification of a new brain-specific transcription factor, NURR1. Molec. Endocr. 6:2129-2135, 1992.

1966. Mages, H. W.; Rilke, O.; Bravo, R.; Senger, G.; Kroczek, R. A.: NOT, a human immediate-early response gene closely related to the steroid/thyroid hormone receptor NAK1/TR3. Molec. Endocr. 8: 1583-1591, 1994.

1967. McEvoy, A. N.; Murphy, E. A.; Ponnio, T.; Conneely, O. M.; Bresnihan, B.; FitzGerald, O.; Murphy, E. P.: Activation of nuclear orphan receptor NURR1 transcription by NF-kappa B and cyclic adenosine 5-prime-monophosphate response element-binding protein in rheumatoid arthritis synovial tissue. J. Immun. 168: 2979-2987, 2002.

1968. Okabe, T.; Takayanagi, R.; Imasaki, K.; Haji, M.; Nawata, H.; Watanabe, T.: cDNA cloning of a NGFIB/nur77-related transcription factor from an apoptotic human T cell line. J. Immun. 154: 3871-3879, 1995.

1969. Torii, T.; Kawarai, T.; Nakamura, S.; Kawakami, H.: Organization of the human orphan nuclear receptor Nurr1 gene. Gene 230: 225-232, 1999.

1970. Xu, P.-Y.; Liang, R.; Jankovic, J.; Hunter, C.; Zeng, Y.-X.; Ashizawa, T.; Lai, D.; Le, W.-D.: Association of homozygous 7048G7049 variant in the intron six of Nurr1 gene with Parkinson's disease. Neurology 58:881-884, 2002.

1971. Kershaw, D. B.; Beck, S. G.; Wharram, B. L.; Wiggins, J. E.; Goyal, M.; Thomas, P. E.; Wiggins, R. C.: Molecular cloning and characterization of human podocalyxin-like protein: orthologous relationship to rabbit PCLP1 and rat podocalyxin. J. Biol. Chem. 272: 15708-15714, 1997.

1972. Kershaw, D. B.; Wiggins, J. E.; Wharram, B. L.; Wiggins, R. C.: Assignment of the human podocalyxin-like protein (PODXL) gene to 7q32-q33. Genomics 45: 239-240, 1997.

1973. Mankodi, A.; Urbinati, C. R.; Yuan, Q.-P.; Moxley, R. T.; Sansone, V.; Krym, M.; Henderson, D.; Schalling, M.; Swanson, M. S.; Thornton, C. A.: Muscle blind localizes to nuclear foci of aberrant RNA in myotonic dystrophy types 1 and 2. Hum. Molec. Genet. 10: 2165-2170, 2001.

1974. Ichikawa, S.; Ozawa, K.; Hirabayashi, Y.: Assignment of a UDP-glucose: ceramideglucosyltransferase gene (Ugcg) to mouse chromosome band 4B3 by insitu hybridization. Cytogenet. Cell Genet. 83: 14-15, 1998.

1975. Ichikawa, S.; Ozawa, K.; Hirabayashi, Y.: Assignment of a UDP-glucose: ceramideglucosyltransferase gene (UGCG) to human chromosome band 9q31 by insitu hybridization. Cytogenet. Cell Genet. 79: 233-234, 1997.

1976. Ichikawa, S.; Sakiyama, H.; Suzuki, G.; Hidari, K. I.-P. J.; Hirabayashi, Y.: Expression cloning of a cDNA for human ceramide glucosyltransferase that catalyzes the first glycosylation step of glycosphingolipid synthesis. Proc. Nat. Acad. Sci. 93: 4638-4643, 1996.

1977. Watanabe, R.; Wu, K.; Paul, P.; Marks, D. L.; Kobayashi, T.; Pittelkow, M. R.; Pagano, R. E.: Upregulation of glucosylceramide synthase expression and activity during human keratinocyte differentiation. J. Biol. Chem. 273: 9651-9655, 1998.

1978. Strahm, B.; Rittweiler, K.; Duffner, U.; Brandau, O.; Orlowska-Volk, M.; Karajannis, M. A.; zur Stadt, U.; Tiemann, M.; Reiter, A.; Brandis, M.; Meindl, A.; Niemeyer, C. M.: Recurrent B-cell non-Hodgkin's lymphomain two brothers with X-linked lymphoproliferative disease without evidence for Epstein-Barr virus infection. Brit. J. Haemat. 108:377-382, 2000.

1979. Sylla, B. S.; Murphy, K.; Cahir-McFarland, E.; Lane, W. S.; Mosialos, G.; Kieff, E.: The X-linked lymphoproliferative syndrome gene product SH2D1A associates with p62(dok) (Dok1) and activates NF-kappa-beta. Proc. Nat. Acad. Sci. 97: 7470-7475, 2000.

1980. Sylla, B. S.; Wang, Q.; Hayoz, D.; Lathrop, G. M.; Lenoir, G. M.: Multipoint linkage mapping of the Xq25-q26 region in a family affected by the X-linked lymphoproliferative syndrome. Clin. Genet. 36:359-462, 1989.

1981. Tangye, S. G.; Lazetic, S.; Woollatt, E.; Sutherland, G. R.; Lanier, L. L.; Phillips, J. H.: Cutting edge: human 2B4, an activating NKcell receptor, recruits the protein tyrosine phosphatase SHP-2 and the adaptor signaling protein SAP. J. Immun. 162: 6981-6985, 1999.

1982. Tangye, S. G.; Phillips, J. H.; Lanier, L. L.; Nichols, K. E.: Cutting edge: functional requirement for SAP in 2B4-mediated activation of human natural killer cells as revealed by the X-linked lymphoproliferative syndrome. J. Immun. 165: 2932-2936, 2000.

1983. Thorley-Lawson, D. A.; Schooley, R. T.; Bhan, A. K.; Nadler, L. M.: Epstein-Barr virus superinduces a new human B cell differentiation antigen (B-LAST 1) expressed on transformed lymphoblasts. Cell 30:415-425, 1982.

1984. Vowels, M. R.; Lam-Po-Tang, R.; Berdoukas, V.; Ford, D.; Thierry, D.; Purtilo, D.; Gluckman, E.: Correction of X-linked lymphoproliferative disease by transplantation of cord-blood stem cells. New Eng. J. Med. 329: 1623-1625, 1993.

1985. Williams, L. L.; Rooney, C. M.; Conley, M. E.; Brenner, M. K.; Krance, R. A.; Heslop, H. E.: Correction of Duncan's syndrome by allogeneic bone marrow transplantation. Lancet 342: 587-588, 1993.

1986. Wu, C.; Nguyen, K. B.; Pien, G. C.; Wang, N.; Gullo, C.; Duncan, H.; Sosa, M. R.; Edwards, M. J.; Borrow, P.; Satoskar, A. R.; Sharpe, A. H.; Biron, C. A.; Terhorst, C.:

SAP controls T cell responses to virus and terminal differentiation of T(H)2 cells. Nature Immun. 2:410-414, 2001.

1987. Wyandt, H. E.; Skare, J. C.; Grierson, H. L.; Purtilo, D. T.; Milunsky, A.: Detection of a chromosomal deletion of Xq25 in an affected male with X-linked lymphoproliferative disease. (Abstract) Am. J. Hum. Genet. 45 (suppl.): A108 only, 1989.

1988. Yin, L.; Ferrand, V.; Lavoue, M.-F.; Hayoz, D.; Philippe, N.; Souillet, G.; Seri, M.; Giacchino, R.; Castagnola, E.; Hodgson, S.; Sylla, B. S.; Romeo, G.: SH2D1A mutation analysis for diagnosis of XLP in typical and a typical patients. Hum. Genet. 105: 501-505, 1999.

1989. Yin, L.; Tocco, T.; Pauly, S.; Lenoir, G. M.; Romeo, G.: Absence of SH2D1A point mutation in 62 Burkitts lymphoma cell lines. Am. J. Hum. Genet. 65 (suppl. 1868): A331 only, 1999.

1990. Dinulos, M. B.; Bassi, M. T.; Rugarli, E. I.; Chapman, V.; Ballabio, A.; Disteche, C. M.: A new region of conservation is defined between human and mouse X chromosomes. Genomics 35: 244-247, 1996.

1991. Schiaffino, M. V.; Bassi, M. T.; Rugarli, E. I.; Renieri, A.; Galli, L.; Ballabio, A.: Cloning of a human homologue of the *Xenopus laevis* APX gene from the ocular albinism type 1 critical region. Hum. Molec. Genet. 4: 373-382, 1995.

1992. Bachner, D.; Sedlacek, Z.; Korn, B.; Hameister, H.; Poustka, A.: Expression patterns of two human genes coding for different rabGDP-dissociation inhibitors (GDIs), extremely conserved proteins involved in cellular transport. Hum. Molec. Genet. 4: 701-708, 1995.

1993. Kang, H.-Y.; Yeh, S.; Fujimoto, N.; Chang, C.: Cloning and characterization of human prostate coactivator ARA54, a novel protein that associates with the androgen receptor. J. Biol. Chem. 274: 8570-8576, 1999.

1994. Foresta, C.; Ferlin, A.; Moro, E.: Deletion and expression analysis of AZFa genes on the human Y chromosome revealed a major role for DBY in male infertility. Hum. Molec. Genet. 9: 1161-1169, 2000.

1995. Shen, P.; Wang, F.; Underhill, P. A.; Franco, C.; Yang, W.-H.; Roxas, A.; Sung, R.; Lin, A. A.; Hyman, R. W.; Vollrath, D.; Davis, R. W.; Cavalli-Sforza, L. L.; Oefner, P. J.: Population genetic implications from sequence variation in four Y chromosome genes. Proc. Nat. Acad. Sci. 97: 7354-7359, 2000.

1996. Scott, D.; Addey, C.; Ellis, P; James, E.; Mitchell, M. J.; Saut, N.; Jurcevic, S.; Simpson, E.: Dendritic cells permit identification of genes encoding MHC class II-restricted epitopes of transplantation antigens. Immunity 12: 711-720, 2000.

1997. Wu, G.; Chai, J.; Suber, T. L.; Wu, J.-W.; Du, C.; Wang, X.; Shi, Y.: Structural basis of IAP recognition by Smac/DIABLO. Nature 408:1008-1012, 2000.

1998. Nakamura, H.; Izumoto, Y.; Kambe, H.; Kuroda, T.; Mori, T.; Kawamura, K.; Yamamoto, H.; Kishimoto, T.: Molecular cloning of complementary DNA for a novel human hepatoma-derived growth factor: its homology with high mobility group-1 protein. J. Biol. Chem. 269: 25143-25149, 1994.

1999. Wanschura, S.; Schoenmakers, E. F. P. M.; Huysmans, C.; Bartnitzke, S.; Van de Ven, W. J. M.; Bullerdiek, J.: Mapping of the gene encoding the human hepatoma-derived growth factor (HDGF) with homology to the high-mobility group (HMG)-1 protein to Xq25. Genomics 32: 298-300, 1996.

2000. Ishibashi, T.; Bottaro, D. P.; Michieli, P.; Kelley, C. A.; Aaronson, S. A.: A novel dual specificity phosphatase induced by serum stimulation and heat shock. J. Biol. Chem. 269: 29897-29902, 1994.

2001. Kwak, S. P.; Dixon, J. E.: Multiple dual specificity protein tyrosine phosphatases are expressed and regulated differentially in liver cell lines. J. Biol. Chem. 270: 1156-1160, 1995.

2002. Lin, J.; Arnold, H. B.; Della-Fera, M. A.; Azain, M. J.; Hartzell, D. L.; Baile, C. A.: Myostatin knockout in mice increases myogenesis and decreases adipogenesis. Biochem. Biophys. Res. Commun. 291:701-706, 2002.

2003. McPherron, A. C.; Lawler, A. M.; Lee, S.-J.: Regulation of skeletal muscle mass in mice by a new TGF-beta superfamily member. Nature 387:83-90, 1997.

2004. Meyerhardt, J. A.; Look, A. T.; Bigner, S. H.; Fearon, E. R.: Identification and characterization of neogenin, a DCC-related gene. Oncogene 14:1129-1136, 1997.

2005. Vielmetter, J.; Chen, X.-N.; Miskevich, F.; Lane, R. P.; Yamakawa, K.; Korenberg, J. R.; Dreyer, W. J.: Molecular characterization of human neogenin, a DCC-related protein, and the mapping of its gene (NEO1) to chromosomal position 15q22.3-q23. Genomics 41: 414-421, 1997.

2006. Vielmetter, J.; Kayyem, J. F.; Roman, J. M.; Dreyer, W. J.: Neogenin, an avian cell surface protein expressed during terminal neuronal differentiation, is closely related to the human tumor suppressor molecule deleted in colorectal cancer. J. Cell Biol. 127: 2009-2020, 1994.

2007. Donghi, R.; Sozzi, G.; Pierotti, M. A.; Biunno, I.; Miozzo, M.; Fusco, A.; Grieco, M.; Santoro, M.; Vecchio, G.; Spurr, N. K.; DellaPorta, G.: The oncogene associated with human papillary thyroid carcinoma (PTC) is assigned to chromosome 10q11-q12 in the same region as multiple endocrine neoplasia type 2A (MEN2A). Oncogene 4: 521-523, 1989.

2008. Nikiforova, M. N.; Stringer, J. R.; Blough, R.; Medvedovic, M.; Fagin, J. A.; Nikiforov, Y. E.: Proximity of chromosomal loci that participate in radiation-induced rearrangements in human cells. Science 290:138-141, 2000.

2009. Sozzi, G.; Pierotti, M. A.; Miozzo, M.; Donghi, R.; Radice, P.; De Benedetti, V.; Grieco, M.; Santoro, M.; Fusco, A.; Vecchio, G.; Mathew, C. G. P.; Ponder, B. A. J.; Spurr, N. K.: Refined localization to contiguous regions on chromosome 10q of the two genes (H4 and RET) that form the oncogenic sequence PTC. Oncogene 6: 339-342, 1991.

2010. Tong, Q.; Li, Y.; Smanik, P. A.; Fithian, L. J.; Xing, S.; Mazzaferri, E. L.; Jhiang, S. M.: Characterization of the promoter region and oligomerization domain of H4 (D10S170), a gene frequently rearranged with the ret proto-oncogene. Oncogene 10: 1781-1787, 1995.

2011. Spicer, A. P.; Olson, J. S.; McDonald, J. A.: Molecular cloning and characterization of a cDNA encoding the third putative mammalian hyaluronan synthase. J. Biol. Chem. 272: 8957-8961, 1997.

2012. Bingle, C. D.; Gowan, S.: Molecular cloning of the fork head transcription factor HNF-3-alpha from a human pulmonary adenocarcinoma cell line. Biochim. Biophys. Acta 1307: 17-20, 1996.

2013. Cushman, L. J.; Camper, S. A.: Molecular basis of pituitary dysfunction in mouse and human. Mammalian Genome 12: 485-494, 2001.

2014. Biamonti, G.; Ruggiu, M.; Saccone, S.; Della Valle, G.; Riva, S.: Two homologous genes, originated by duplication, encode the human hnRNP proteins A2 and A1. Nucleic Acids Res. 22: 1996-2002, 1994.

2015. Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human genes. VI. The coding sequences of 80 new genes (KIAA0201-KIAA0280) deduced by analysis of cDNA clones from cell line KG-1 and brain. DNA Res. 3: 321-329, 1996. Note: Supplement: DNA Res. 3: 341-354, 1996.

2016. Numata, M.; Petrecca, K.; Lake, N.; Orlowski, J.: Identification of a mitochondrial Na+/H+ exchanger. J. Biol. Chem. 273: 6951-6959, 1998.

2017. Nakano, H.; Oshima, H.; Chung, W.; Williams-Abbott, L.; Ware, C. F.; Yagita, H.; Okumura, K.: TRAF5, an activator of NF-kappaB and putative signal transducer for the lymphotoxin-beta receptor. J. Biol. Chem. 271: 14661-14664, 1996.

2018. Nakano, H.; Sakon, S.; Koseki, H.; Takemori, T.; Tada, K.; Matsumoto, M.; Munechika, E.; Sakai, T.; Shirasawa, T.; Akiba, H; Kobata, T.; Santee, S. M.; Ware, C. F.; Renner, P. D.; Taniguchi, M.; Yagita, H.; Okumura, K.: Targeted disruption of Traf5 gene causes defects in CD40- and CD27-mediated lymphocyte activation. Proc. Nat. Acad. Sci. 96: 9803-9808, 1999.

2019. Nakano, H.; Shindo, M.; Yamada, K.; Yoshida, M. C.; Santee, S. M.; Ware, C. F.; Jenkins, N. A.; Gilbert, D. J.; Yagita, H.; Copeland, N. G.; Okumura, K.: Human TNF receptor-associated factor 5 (TRAF5): cDNA cloning, expression and assignment of the TRAF5 gene to chromosome 1q32. Genomics 42: 26-32, 1997.

2020. Fernandez-Valle, C.; Tang, Y.; Ricard, J.; Rodenas-Ruano, A.; Taylor, A.; Hackler, E.; Biggerstaff, J.; Iacovelli, J.: Paxillin binds schwannomin and regulates its density-dependent localization and effect on cell morphology. Nature Genet. 31: 354-362, 2002.

2021. Glenney, J. R., Jr.; Zokas, L.: Novel tyrosine kinase substrates from Rous sarcoma virus-transformed cells are present in the membrane skeleton. J. Cell Biol. 108: 2401-2408, 1989.

2022. Mazaki, Y.; Hashimoto, S.; Sabe, H.: Monocyte cells and cancer cells express novel paxillin isoforms with different binding properties to focal adhesion proteins. J. Biol. Chem. 272: 7437-7444, 1997.

2023. Salgia, R.; Li, J.-L.; Lo, S. H.; Brunkhorst, B.; Kansas, G. S.; Sobhany, E. S.; Sun, Y.; Pisick, E.; Hallek, M.; Ernst, T.; Tantravahi, R.; Chen, L. B.; Griffin, J. D.: Molecular cloning of human paxillin, a focal adhesion protein phosphorylated by P210(BCR/ABL). J. Biol. Chem. 270: 5039-5047, 1995.

2024. Turner, C. E.; Glenney, J. R., Jr.; Burridge, K.: Paxillin: a new vinculin-binding protein present in focal adhesions. J. Cell Biol. 111: 1059-1068, 1990.

2025. Adachi, H.; Tsujimoto, M.; Hattori, M.; Arai, H.; Inoue, K.: Differential tissue distribution of the beta- and gamma-subunits of human cytosolic platelet-activating factor acetylhydrolase (isoform 1). Biochem. Biophys. Res. Commun. 233: 10-13, 1997.

2026. Moro, F.; Arrigo, G.; Fogli, A.; Bernard, L.; Carrozzo, R.: The beta and gamma subunits of the human platelet-activating factor acetylhydrolase isoform Ib (PAFAH1B2 and PAFAH1B3) map to chromosome 11q23 and 19q13.1, respectively. Genomics 51: 157-159, 1998.

2027. Daigo, Y.; Isomura, M.; Nishiwaki, T.; Tamari, M.; Ishikawa, S.; Kai, M.; Murata, Y.; Takeuchi, K.; Yamane, Y.; Hayashi, R.; Minami, M.; Fujino, M. A.; Hojo, Y.; Uchiyama, I.; Takagi, T.; Nakamura, Y.: Characterization of a 1200-kb genomic segment of chromosome 3p22-p21.3. DNA Res. 6: 37-44, 1999.

2028. Erlich, R.; Gleeson, P. A.; Campbell, P.; Dietzsch, E.; Toh, B.-H.: Molecular characterization of trans-Golgi p230: a human peripheral membrane protein encoded by a gene on chromosome 6p12-22 contain sextensive coiled-coil alpha-helical domains and a granin motif. J. Biol. Chem. 271: 8328-8337, 1996.

2029. Giachino, C.; Lantelme, E.; Lanzetti, L.; Saccone, S.; Della Valle, G.; Migone, N.: A novel SH3-containing human gene family preferentially expressed in the central nervous system. Genomics 41: 427-434, 1997.

2030. Shisheva, A.; Sudhof, T. C.; Czech, M. P.: Cloning, characterization, and expression of a novel GDP dissociation inhibitor isoform from skeletal muscle. Molec. Cell. Biol. 14: 3459-3468, 1994.

2031. Peters, A. H. F. M.; O'Carroll, D.; Scherthan, H.; Mechtler, K.; Sauer, S.; Schofer, C.; Weipoltshammer, K.; Pagani, M.; Lachner, M.; Kohlmaier, A.; Opravil, S.; Doyle, M.; Sibilia, M.; Jenuwein, T.: Loss of the Suv39h histone methyltransferases impairs mammalian heterochromatin and genome stability. Cell 107: 323-337, 2001.

2032. Haltiwanger, R. S.; Blomberg, M. A.; Hart, G. W.: Glycosylation of nuclear and cytoplasmic proteins: purification and characterization of a uridine diphospho-N-acetylglucosamine: polypeptide beta-N-acetylglucosaminyltransferase. J. Biol. Chem. 267: 9005-9013, 1992.

2033. Kreppel, L. K.; Blomberg, M. A.; Hart, G. W.: Dynamic glycosylation of nuclear and cytosolic proteins: cloning and characterization of a unique O-GlcNAc transferase with multiple tetratricopeptide repeats. J. Biol. Chem. 272: 9308-9315, 1997.

2034. Lubas, W. A.; Frank, D. W.; Krause, M.; Hanover, J. A.: O-linked GlcNAc transferase is a conserved nucleocytoplasmic protein containing tetratricopeptide repeats. J. Biol. Chem. 272: 9316-9324, 1997.

2035. Shafi, R.; Iyer, S. P. N.; Ellies, L. G.; O'Donnell, N.; Marek, K. W.; Chui, D.; Hart, G. W.; Marth, J. D.: The OGlcNAc transferase gene resides on the X chromosome and is essential for embryonic stem cell viability and mouse ontogeny. Proc. Nat. Acad. Sci. 97: 5735-5739, 2000.

2036. Yang, X.; Zhang, F.; Kudlow, J. E.: Recruitment of OGlcNAc transferase to promoters by corepressor mSin3A: coupling protein O-GlcNAcylation to transcriptional repression. Cell 110: 69-80, 2002.

2037. Gecz, J.; Baker, E.; Donnelly, A.; Ming, J. E.; McDonald-McGinn, D. M.; Spinner, N. B.; Zackai, E. H.; Sutherland, G. R.; Mulley, J. C.: Fibroblast growth factor homologous factor 2 (FHF2): gene structure, expression and mapping to the Borjeson-Forssman-Lehmann syndrome region in Xq26 delineated by a duplication breakpoint in a BFLS-like patient. Hum. Genet. 104: 56-63, 1999.

2038. Lovec, H.; Hartung, H.; Verdier, A.-S.; Mattei, M.-G.; Birnbaum, D.; Goldfarb, M.; Coulier, F.: Assignment of FGF13 to human chromosome band Xq21 by in situ hybridization. Cytogenet. Cell Genet. 76: 183-184, 1997.

2039. Smallwood, P. M.; Munoz-Sanjuan, I.; Tong, P.; Macke, J. P.; Hendry, S. H. C.; Gilbert, D. J.; Copeland, N. G.; Jenkins, N. A.; Nathans, J.: Fibroblast growth factor (FGF) homologous factors: new members of the FGF family implicated in nervous system development. Proc. Nat. Acad. Sci. 93: 9850-9857, 1996.

2040. Nauseef, W. M.; Brigham, S.; Cogley, M.: Hereditary myeloperoxidase deficiency due to a missense mutation of arginine 569 to tryptophan. J. Biol. Chem. 269: 1212-1216, 1994.

2041. Busard, B. L. S. M.; Renier, W. O.; Gabreels, F. J. M.; Jaspar, H. H. J.; van Haelst, U. J. G.; Slooff, J. L.: Lafora's disease: comparison of inclusion bodies in skin and in brain. Arch. Neurol. 43:296-299, 1986.

2042. Busard, H. L. S. M.; Gabreels-Festen, A. A. W. M.; Renier, W. O.; Gabreels, F. J. M.; Stadhouders, A. M.: Axilla skin biopsy: a reliable test for the diagnosis of Lafora's disease. Ann. Neurol. 21: 599-601, 1987.

2043. Fluharty, A. L.; Porter, M. T.; Hirsh, G. A.; Pevida, E.; Kihara, H.: Metachromasia in fibroblasts from a patient with Lafora's disease. (Letter) Lancet II: 109-110, 1970.

2044. Ganesh, S.; Agarwala, K. L.; Ueda, K.; Akagi, T.; Shoda, K.; Usui, T.; Hashikawa, T.; Osada, H.; Delgado-Escueta, A. V.; Yamakawa, K.: Laforin, defective in the progressive myoclonus epilepsy of Laforatype, is a dual-specificity phosphatase associated with polyribosomes. Hum. Molec. Genet. 9: 2251-2261, 2000.

2045. Gomez-Garre, P.; Sanz, Y.; Rodriguez de Cordoba, S.; Serratosa, J. M.: Mutational spectrum of the EPM2A gene in progressive myoclonusepilepsy of Lafora: high degree of allelic heterogeneity and prevalence of deletions. Europ. J. Hum. Genet. 8: 946-954, 2000.

2046. Harriman, D. G. F.; Millar, J. H. D.: Progressive familial myoclonicepilepsy in 3 families: its clinical features and pathological basis. Brain 78:325-349, 1955.

2047. Janeway, R.; Ravens, J. R.; Pearce, L. A.; Odor, D. L.; Suzuki, K.: Progressive myoclonus epilepsy with Lafora inclusion bodies. I. Clinical, genetic, histopathologic and biochemical aspects. Arch. Neurol. 16: 565-582, 1967.

2048. Lehesjoki, A.-E.; Koskiniemi, M.; Pandolfo, M.; Antonelli, A.; Kyllerman, M.; Wahlstrom, J.; Nergardh, A.; Burmeister, M.; Sistonen, P.; Norio, R.; de la Chapelle, A.: Linkage studies in progressive myoclonus epilepsy: Unverricht-Lundborg and Lafora's diseases. Neurology 42:1545-1550, 1992.

2049. Maddox, L. O.; Descartes, M.; Collins, J.; Keating, J.; Rosenfeld, S.; Palmer, C.; Carroll, A. J.; Kuzniecky, R.: Identification of a recombination event narrowing the Lafora disease gene region. J. Med. Genet. 34: 590-591, 1997.

2050. Solinas-Toldo, S.; Lengauer, C.; Fries, R.: Comparative genome map of human and cattle. Genomics 27: 489-496, 1995.

2051. Olives, B.; Martial, S.; Mattei, M.-G.; Matassi, G.; Rousselet, G.; Ripoche, P.; Cartron, J.-P.; Bailly, P.: Molecular characterization of a new urea transporter in the human kidney. FEBS Lett. 386: 156-160, 1996.

2052. Ranade, K.; Wu, K.-W.; Hwu, C.-M.; Ting, C.-T.; Pei, D.; Pesich, R.; Hebert, J.; Chen, Y.-D. I.; Pratt, R.; Olshen, R.; Masaki, K.; Risch, N.; Cox, D. R.; Botstein, D.: Genetic variation in the human urea transporter-2 is associated with variation in blood pressure. Hum. Molec. Genet. 10: 2157-2164, 2001.

2053. Ansel, K. M.; Ngo, V. N.; Hyman, P. L.; Luther, S. A.; Forster, R.; Sedgwick, J. D.; Browning, J. L.; Lipp, M.; Cyster, J. G.: A chemokine-driven positive feedback loop organizes lymphoid follicles. Nature 406:309-314, 2000.

2054. Petersen, S.; Casellas, R.; Reina-San-Martin, B.; Chen, H. T.; Difilippantonio, M. J.; Wilson, P. C.; Hanitsch, L.; Celeste, A.; Muramatsu, M.; Pilch, D. R.; Redon, C.; Ried, T.; Bonner, W. M.; Honjo, T.; Nussenzweig, M. C.; Nussenzweig, A.: AID is required to initiate Nbs1/gamma-H2AX focus formation and mutations at sites of class switching. Nature 414:660-665, 2001.

2055. Morasso, M. I.; Yonescu, R.; Griffin, C. A.; Sargent, T. D.: Localization of human DLX8 to chromosome 17q21.3-q22 by fluorescence in situ hybridization. Mammalian Genome 8: 302-303, 1997.

2056. Quinn, L. M.; Johnson, B. V.; Nicholl, J.; Sutherland, G. R.; Kalionis, B.: Isolation and identification of homeobox genes from the human placenta including a novel member of the Distal-less family, DLX4. Gene 187: 55-61, 1997.

2057. Bengtsson, E.; Neame, P. J.; Heinegard, D.; Sommarin, Y.: The primary structure of a basic leucine-rich repeat protein, PRELP, found in connective tissues. J. Biol. Chem. 270: 25639-25644, 1995.

2058. Grover, J.; Chen, X.-N.; Korenberg, J. R.; Recklies, A. D.; Roughley, P. J.: The gene organization, chromosome location, and expression of a 55-kDa matrix protein (PRELP) of human articular cartilage. Genomics 38:109-117, 1996.

2059. Blanco, P.; Sargent, C. A.; Boucher, C. A.; Mitchell, M.; Affara, N. A.: Conservation of PCDHX in mammals; expression of X/Y genes predominantly in brain. Mammalian Genome 11: 906-914, 2000.

2060. Ciccodicola, A.; D'Esposito, M.; Esposito, T.; Gianfrancesco, F.; Migliaccio, C.; Miano, M. G.; Matarazzo, M. R.; Vacca, M.; Franze, A.; Cuccurese, M.; Cocchia, M.; Curci, A.; and 9 others: Differentially regulated and evolved genes in the fully sequenced Xq/Yq pseudoautosomal region. Hum. Molec. Genet. 9: 395-401, 2000.

2061. Mumm, S.; Molini, B.; Terrell, J.; Srivastava, A.; Schlessinger, D.: Evolutionary features of the 4-Mb Xq21.3 X-Y homology region revealed by a map at 60-kb resolution. Genome Res. 7: 307-314, 1997.

2062. Schwartz, A.; Chan, D. C.; Brown, L. G.; Alagappan, R.; Pettay, D.; Disteche, C.; McGillivray, B.; de la Chapelle, A.; Page, D. C.: Reconstructing hominid Y evolution: Xhomologous block, created by X-Y transposition, was disrupted by Yp inversion through LINE-LINE recombination. Hum. Molec. Genet. 7: 1-11, 1998.

2063. Tilford, C. A.; Kuroda-Kawaguchi, T.; Skaletsky, H.; Rozen, S.; Brown, L. G.; Rosenberg, M.; McPherson, J. D.; Wylie, K.; Sekhon, M.; Kucaba, T. A.; Waterston, R. H.; Page, D. C.: A physical map of the human Y chromosome. Nature 409: 943-945, 2001.

2064. Yoshida, K.; Sugano, S.: Identification of a novel protocadherin gene (PCDH11) on the human XY homology region in Xq21.3. Genomics 62:540-543, 1999.

2065. Liu, Z.; Sun, C.; Olejniczak, E. T.; Meadows, R. P.; Betz, S. F.; Oost, T.; Herrmann, J.; Wu, J. C.; Fesik, S. W.: Structural basis for binding of Smac/DIABLO to the XIAP BIR3 domain. Nature 408:1004-1008, 2000.

2066. Srinivasula, S. M.; Hegde, R.; Saleh, A.; Datta, P.; Shiozaki, E.; Chai, J.; Lee, R.-A.; Robbins, P. D.; Fernandes-Alnemri, T.; Shi, Y.; Alnemri, E. S.: A conserved XIAP-interaction motif in caspase-9 and Smac/DIABLO regulates caspase activity and apoptosis. Nature 410:112-116, 2001.

2067. Bomont, P.; Cavalier, L.; Blondeau, F.; Ben Hamida, C.; Belal, S.; Tazir, M.; Demir, E.; Topaloglu, H.; Korinthenberg, R.; Tuysuz, B.; Landrieu, P.; Hentati, F.; Koenig, M.: The gene encoding gigaxonin, a new member of the cytoskeletal BTB/kelch repeat family, is mutated in giant axonal neuropathy. Nature Genet. 26: 370-374, 2000.

2068. Treiber-Held, S.; Budjarjo-Welim, H.; Riemann, D.; Richter, J.; Kretzschmar, H. A.; Hanefeld, F.: Giant axonal neuropathy: a generalize ddisorder of intermediate filaments with longitudinal grooves in the hair. Neuropediatrics 25: 89-93, 1994.

2069. Minassian, B. A.; Lee, J. R.; Herbrick, J.-A.; Huizenga, J.; Soder, S.; Mungall, A. J.; Dunham, I.; Gardner, R.; Fong, C. G.; Carpenter, S.; Jardim, L.; Satishchandra, P.; Andermann, E.; Snead, O. C., III; Lopes-Cendes, I.; Tsui, L.-C.; Delgado-Escueta, A. V.; Rouleau, G. A.; Scherer, S. W.: Mutations in a gene encoding a novel protein tyrosine phosphatase cause progressive myoclonus epilepsy. Nature Genet. 20: 171-174, 1998.

2070. Norio, R.; Koskiniemi, M.: Progressive myoclonus epilepsy: genetic and nosological aspects with special reference to 107 Finnish patients. Clin. Genet. 15: 382-398, 1979.

2071. Ortiz-Hidalgo, C.: The man behind Lafora's bodies. Am. J. Surg. Path. 10: 358-361, 1986.

2072. Sainz, J.; Minassian, B. A.; Serratosa, J. M.; Gee, M. N.; Sakamoto, L. M.; Iranmanesh, R.; Bohlega, S.; Baumann, R. J.; Ryan, S.; Sparkes, R. S.; Delgado-Escueta, A. V.: Lafora progressive myoclonus epilepsy: narrowing the chromosome 6q24 locus by recombinations and homozygosities. (Letter) Am. J. Hum. Genet. 61: 1205-1209, 1997.

2073. Sarlin, M. B.; Kloepfer, H. W.; Mickle, W. A.; Heath, R. G.: The detection of carriers in hereditary myoclonic epilepsy. Acta Genet. Med. Gemellol. 9: 466-471, 1960.

2074. Schwarz, G. A.; Yanoff, M.: Lafora's disease, distinct clinico-pathologic form of Unverricht's syndrome. Arch. Neurol. 12: 172-188, 1965.

2075. Serratosa, J. M.; Delgado-Escueta, A. V.; Posada, I.; Shih, S.; Drury, I.; Berciano, J.; Zabala, J. A.; Antunez, M. C.; Sparkes, R. S.: The gene for progressive myoclonus epilepsy of the Lafora type maps to chromosome 6q. Hum. Molec. Genet. 4: 1657-1663, 1995.

2076. Serratosa, J. M.; Gomez-Garre, P.; Gallardo, M. E.; Anta, B.; Beltran-Valero de Bernabe, D.; Lindhout, D.; Augustijn, P. B.; Tassinari, C. A.; Michelucci, R.; Malafosse, A.; Topcu, M.; Grid, D.; Dravet, C.; Berkovic, S. F.; Rodriguez de Cordoba, S.: A novel protein tyrosine phosphatase gene is mutated in progressive myoclonus epilepsy of the Lafora type (EPM2). Hum. Molec. Genet. 8: 345-352, 1999.

2077. Yanoff, M.; Schwarz, G. A.: Lafora's disease: a distinct genetically determined form of Unverricht's syndrome. Genet. Hum. 14: 235-244, 1965.

2078. Yokoi, S.; Austin, J.; Witmer, F.; Sakai, M.: Studies in myoclonus epilepsy (Lafora body forms). I. Isolation and preliminary characterization of Lafora bodies in two cases. Arch. Neurol. 19: 15-33, 1968.

2079. Carney, J. P.; Maser, R. S.; Olivares, H.; Davis, E. M.; Le Beau, M.; Yates, J. R., III; Hays, L.; Morgan, W. F.; Petrini, J. H. J.: The hMre11/hRad50 protein complex and Nijmegen breakage syndrome: linkage of double-strand break repair to the cellular DNA damage response. Cell 93:477-486, 1998.

2080. Chang, S. C.; Hoang, B.; Thomas, J. T.; Vukicevic, S.; Luyten, F. P.; Ryba, N. J. P.; Kozak, C. A.; Reddi, A. H.; Moos, M., Jr.: Cartilage-derived morphogenetic proteins: new members of the transforming growth factor-beta superfamily predominantly expressed in long bones during human embryonic development. J. Biol. Chem. 269: 28227-28234, 1994.

2081. Faiyaz-UI-Haque, M.; Ahmad, W.; Wahab, A.; Haque, S.; Azim, A. C.; Zaidi, S. H. E.; Teebi, A. S.; Ahmad, M.; Cohn, D. H.; Siddique, T.; Tsui, L.-C.: Frameshift mutation in the cartilage-derived morphogenetic protein 1 (CDMP1) gene and severe acromesomelic chondrodysplasia resembling Grebe-type chondrodysplasia. Am. J. Med. Genet. 111: 31-37, 2002.

2082. Rousseau-Merck, M.-F.; Duro, D.; Berger, R.; Thiesen, H. J.: Chromosomal localization of two KOX zinc finger genes on chromosome bands 7q21-q22. Ann. Genet. 38: 81-84, 1995.

2083. Tommerup, N.; Vissing, H.: Isolation and fine mapping of 16 novel human zinc finger-encoding cDNAs identify putative candidate genes for developmental and malignant disorders. Genomics 27: 259-264, 1995.

2084. Boring, L.; Gosling, J.; Cleary, M.; Charo, I. F.: Decreased lesion formation in CCR2 -/- mice reveals a role for chemokines in the initiation of atherosclerosis. Nature 394: 894-897, 1998.

2085. Charo, I. F.; Myers, S. J.; Herman, A.; Franci, C.; Connolly, A. J.; Coughlin, S. R.: Molecular cloning and functional expression of two monocyte chemoattractant protein 1 receptors reveals alternative splicing of the carboxyl-terminal tails. Proc. Nat. Acad. Sci. 91:2752-2756, 1994.

2086. Chang, C.; da Silva, S. L.; Ideta, R.; Lee, Y.; Yeh, S.; Burbach, J. P. H.: Human and rat TR4 orphan receptors specify a subclass of the steroid receptor superfamily. Proc. Nat. Acad. Sci. 91: 6040-6044, 1994.

2087. Chang, C.; Kokontis, J.; Acakpo-Satchivi, L.; Liao, S.; Takeda, H.; Chang, Y.: Molecular cloning of new human TR2 receptors: a class of steroid receptor with multiple ligand-binding domains. Biochem. Biophys. Res. Commun. 165: 735-741, 1989.

2088. Hirose, T.; Fujimoto, W.; Yamaai, T.; Kim, K. H.; Matsuura, H.; Jetten, A. M.: TAK1: Molecular cloning and characterization of anew member of the nuclear receptor superfamily. Molec. Endocr. 1667-1680, 1994.

2089. Yoshikawa, T.; DuPont, B. R.; Leach, R. J.; Detera-Wadleigh, S. D.: New variants of the human and rat nuclear hormone receptor, TR4: expression and chromosomal localization of the human gene. Genomics 35:361-366, 1996.

2090. Choe, H.; Farzan, M.; Sun, Y.; Sullivan, N.; Rollins, B.; Ponath, P. D.; Wu, L.; Mackay, C. R.; LaRosa, G.; Newman, W.; Gerard, N.; Gerard, C.; Sodroski, J.: The betachemokine receptors CCR3 and CCR5 facilitate infection by primary HIV-1 isolates. Cell 85: 1135-1148, 1996.

2091. Kim, B.-T.; Kitagawa, H.; Tamura, J.; Saito, T.; Kusche-Gullberg, M.; Lindahl, U.; Sugahara, K.: Human tumor suppressor EXT gene family members EXTL1 and EXTL3 encode alpha-1,4-N-acetylglucosaminyl transferases that likely are involved in heparan sulfate/heparin biosynthesis. Proc. Nat. Acad. Sci. 98: 7176-7181, 2001.

2092. Wise, C. A.; Clines, G. A.; Massa, H.; Trask, B. J.; Lovett, M.: Identification and localization of the gene for EXTL, a third member of the multiple exostoses gene family. Genome Res. 7: 10-16, 1997.

2093. Kobayashi, S.; Uemura, H.; Kohda, T.; Nagai, T.; Chinen, Y.; Naritomi, K.; Kinoshita, E.; Ohashi, H.; Imaizumi, K.; Tsukahara, M.; Sugio, Y.; Tonoki, H.; Kishino, T.; Tanaka, T.; Yamada, M.; Tsutsumi, O.; Niikawa, N.; Kaneko-Ishino, T.; Ishino, F.: No evidence of PEG1/MEST gene mutations in Silver-Russell syndrome patients. Am. J. Med. Genet. 104:225-231, 2001.

2094. Bosher, J. M.; Williams, T.; Hurst, H. C.: The developmentally regulated transcription factor AP-2 is involved in c-erbB-2 overexpression in human mammary carcinoma. Proc. Nat. Acad. Sci. 92: 744-747, 1995.

2095. Combadiere, C.; Ahuja, S. K.; Murphy, P. M.: Cloning, chromosomal localization, and RNA expression of a human beta chemokine receptor-like gene. DNA Cell Biol. 14: 673-680, 1995.

2096. Combadiere, C.; Ahuja, S. K.; Van Damme, J.; Tiffany, H. L.; Gao, J.-L.; Murphy, P. M.: Monocyte chemoattractant protein-3 is a functional ligand for CC chemokine receptors 1 and 2B. J. Biol. Chem. 270:29671-29675, 1995.

2097. Doranz, B. J.; Rucker, J.; Yi, Y.; Smyth, R. J.; Samson, M.; Peiper, S. C.; Parmentier, M.; Collman, R. G.; Doms, R. W.: A dual-tropic primary HIV-1 isolate that uses fusin and the beta-chemokine receptors CKR-5, CKR-3, and CKR-2b as fusion cofactors. Cell 85: 1149-1158, 1996.
2098. Mummidi, S.; Ahuja, S. S.; Gonzalez, E.; Anderson, S. A.; Santiago, E. N.; Stephan, K. T.; Craig, F. E.; O'Connell, P.; Tryon, V.; Clark, R. A.; Dolan, M. J.; Ahuja, S. K.: Genealogy of the CCR5 locus and chemokine system gene variants associated with altered rates of HIV-1 disease progression. Nature Med. 4: 786-793, 1998.
2099. Peters, W.; Dupuis, M.; Charo, I. F.: A mechanism for the impaired IFN-gamma production in C-C chemokine receptor 2 (CCR2) knockout mice: role of CCR2 in linking the innate and adaptive immune responses. J. Immun. 165: 7072-7077, 2000.
2100. Peters, W.; Scott, H. M.; Chambers, H. F.; Flynn J. L.; Charo, I. F.; Ernst, J. D.: Chemokine receptor 2 serves an early and essential role in resistance to Mycobacterium tuberculosis. Proc. Nat. Acad. Sci. 98: 7958-7963, 2001.
2101. Samson, M.; Labbe, O.; Mollereau, C.; Vassart, G.; Parmentier, M.: Molecular cloning and functional expression of a new human CC-chemokine receptor gene. Biochemistry 35: 3362-3367, 1996.
2102. Samson, M.; Soularue, P.; Vassart, G.; Parmentier, M.: The genes encoding the human CC-chemokine receptors CC-CKR1 to CC-CKR5 (CMKBR1-CMKBR5) are clustered in the p21.3-p24 region of chromosome 3. Genomics 36:522-526, 1996.
2103. Sanders, S. K.; Crean, S. M.; Boxer, P. A.; Kellner, D.; LaRosa, G. J.; Hunt, S. W., III.: Functional differences between monocytechemotactic protein-1 receptor A and monocyte chemotactic protein-1 receptor B expressed in a Jurkat T cell. J. Immun. 165: 4877-4883, 2000.
2104. Smith, M. W.; Dean, M.; Carrington, M.; Winkler, C.; Huttley, G. A.; Lomb, D. A.; Goedert, J. J.; O'Brien, T. R.; Jacobson, L. P.; Kaslow, R.; Buchbinder, S.; Vittinghoff, E.; Vlahov, D.; Hoots, K.; Hilgartner, M. W.; Hemophilia Growth and Development Study (HGDS); Multicenter AIDS Cohort Study (MACS); Multicenter Hemophilia Cohort Study (MHCS); San Francisco City Cohort (SFCC); ALIVE Study; O'Brien, S. J.: Contrasting genetic influence of CCR2 and CCR5 variants on HIV-1 infection and disease progression. Science 277: 959-965, 1997.
2105. Wong, L.-M.; Myers, S. J.; Tsou, C.-L.; Gosling, J.; Arai, H.; Charo, I. F.: Organization and differential expression of the human monocyte chemoattractant protein 1 receptor gene: evidence for the role of the carboxyl-terminal tail in receptor trafficking. J. Biol. Chem. 272: 1038-1045, 1997.
2106. Donald, L. J.; Wang, H. S.; Hamerton, J. L.: Assignment of the gene for cystathionase (CYS) to human chromosome 16. (Abstract) Cytogenet. Cell Genet. 32: 268 only, 1982.
2107. Frimpter, G. W.: Cystathioninuria: nature of the defect. Science 149:1095-1096, 1965.
2108. Frimpter, G. W.: Cystathioninuria, sulfite oxidase deficiency, and 'beta-mercaptolactate-cysteine disulfiduria. In: Stanbury, J. B.; Wyngaarden, J. B.; Fredrickson, D. S.: The Metabolic Basis of Inherited Disease. New York: McGraw-Hill (pub.) (3rd ed.): 1972. Pp. 413-425.
2109. Frimpter, G. W.; Haymovitz, A.; Hor with, M.: Cystathioninuria. New Eng. J. Med. 268: 333-339, 1963.
2110. Harris, H.; Penrose, L. S.; Thomas, D. H. H.: Cystathioninuria. Ann. Hum. Genet. 23: 442-453, 1959.
2111. Lu, Y.; O'Dowd, B. F.; Orrego, H.; Israel, Y.: Cloning and nucleotide sequence of human liver cDNA encoding for cystathionine gamma-lyase. Biochem. Biophys. Res. Commun. 189: 749-758, 1992.
2112. Lyon, I. C. T.; Procopis, P. G.; Turner, B.: Cystathioninuriain a well baby population. Acta Paediat. Scand. 60: 324-328, 1971.
2113. Mongeau, J.-G.; Hilgartner, M.; Worthen, H. G.; Frimpter, G. W.: Cystathioninuria: study of an infant with normal mentality, thrombocytopenia, and renal calculi. J. Pediat. 69: 1113-1120, 1967.
2114. Pascal, T. A.; Gaull, G. E.; Beratis, N. G.; Gillam, B. M.; Tallan, H. H.: Cystathionase deficiency: evidence for genetic heterogeneity in primary cystathioninuria. Pediat. Res. 12: 125-133, 1978.
2115. Perry, T. L.; Hardwick, D. F.; Hansen, S.; Love, D. L.; Israels, S.: Cystathioninuria in two healthy siblings. New Eng. J. Med. 278:590-592, 1968.
2116. Schneiderman, L. J.: Latent cystathioninuria. J. Med. Genet. 4:260-263, 1967.
2117. Scott, C. R.; Dassell, S. W.; Clark, S. H.; Chiang-Teng, C.; Swedberg, K. R.: Cystathioninemia: a benign genetic condition. J. Pediat. 76:571-577, 1970.
2118. Shaw, K. N. F.; Lieberman, E.; Koch, R.; Donnell, G. N.: Cystathioninuria. Am. J. Dis. Child. 113: 119-128, 1967.
2119. Tada, K.; Yoshida, T.; Yokoyama, Y.; Sato, T.; Nakagawa, H.; Arakawa, T.: Cystathioninuria not associated with vitamin B6 dependency: a probably new type of cystathioninuria. Tohoku J. Exp. Med. 95: 235-242, 1968.
2120. Whelan, D. T.; Scriver, C. R.: Cystathioninuria and renal iminoglycinuriain a pedigree: a perspective on counseling. New Eng. J. Med. 278:924-927, 1968.
2121. Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human genes. VI. The coding sequences of 80 new genes (KIAA0201-KIAA0280) deduced by analysis of cDNA clones from cell line KG-1 and brain. DNA Res. 3: 321-329, 1996.
2122. Connelly, M. A.; Grady, R. C.; Mushinski, J. F.; Marcu, K. B.: PANG, a gene encoding a neuronal glycoprotein, is ectopically activated by intracisternal A-type particle long terminal repeats in murine plasmacytomas. Proc. Nat. Acad. Sci. 91: 1337-1341, 1994.
2123. Mock, B. A.; Connelly, M. A.; McBride, O. W.; Kozak, C. A.; Marcu, K. B.: Plasmacytoma-associated neuronal glycoprotein, Pang, maps to mouse chromosome 6 and human chromosome 3. Genomics 34: 226-228, 1996.
2124. Cheung, A. H.; Stewart, R. J.; Marsden, P. A.: Endothelial Tie2/Tekligands angiopoietin-1 (ANGPT1) and angiopoietin-2 (ANGPT2): regionallocalization of the human genes to 8q22.3-q23 and 8p23. Genomics 48:389-391, 1998.
2125. Davis, S.; Aldrich, T. H.; Jones, P. F.; Acheson, A.; Compton, D. L.; Jain, V.; Ryan, T. E.; Bruno, J.; Radziejewski, C.; Maisonpierre, P. C.; Yancopoulos, G. D.: Isolation of angiopoietin-1, a ligand for the TIE2 receptor, by secretion-trap expression cloning. Cell 87:1161-1169, 1996.
2126. Folkman, J.; D'Amore, P. A.: Blood vessel formation: what is its molecular basis? Cell 87: 1153-1155, 1996.
2127. Marziliano, N.; Crovella, S.; Audero, E.; Pecile, V.; Bussolino, F.; Amoroso, A.; Garagna, S.: Genetic mapping of the mouse homologue of the human angiopoietin-1 gene (Agpt) to mouse chromosome 9E2 byin situ hybridization. Cytogenet. Cell Genet. 87: 199-200, 1999.
2128. Sato, T. N.; Tozawa, Y.; Deutsch, U.; Wolburg-Buchholz, K.; Fujiwara, Y.; Gendron-Maguire, M.; Gridley, T.; Wolburg, H.; Risau, W.; Qin, Y.: Distinct roles of the recep- 2128. tor tyrosine kinases Tie-1 and Tie-2 in blood vessel formation. Nature 376: 70-73, 1995.
2129. Suri, C.; Jones, P. F.; Patan, S.; Bartunkova, S.; Maisonpierre, P. C.; Davis, S.; Sato, T. N.; Yancopoulos, G. D.: Requisite role of angiopoietin-1, a ligand for the TIE2 receptor, during embryonic angiogenesis. Cell 87: 1171-1180, 1996.
2130. Suri, C.; McClain, J.; Thurston, G.; McDonald, D. M.; Zhou, H.; Oldmixon, E. H.; Sato, T. N.; Yancopoulos, G. D.: Increased vascularization in mice overexpressing angiopoietin-1. Science 282: 468-471, 1998.
2131. Valenzuela, D. M.; Griffiths, J. A.; Rojas, J.; Aldrich, T. H.; Jones, P. F.; Zhou, H.; McClain, J.; Copeland, N. G.; Gilbert, D. J.; Jenkins, N. A.; Huang, T.; Papadopoulos, N.; Maisonpierre, P. C.; Davis, S.; Yancopoulos, G. D.: Angiopoietins 3 and 4: diverging gene counterparts in mice and humans. Proc. Nat. Acad. Sci. 96:1904-1909, 1999.
2132. Nakanishi-Matsui, M.; Zheng, Y.-W.; Sulciner, D. J.; Weiss, E. J.; Ludeman, M. J.; Coughlin, S. R.: PAR3 is a cofactor for PAR4 activation by thrombin. Nature 404: 609-613, 2000.
2133. Sambrano, G. R.; Weiss, E. J.; Zheng, Y.-W.; Huang, W.; Coughlin, S. R.: Role of thrombin signalling in platelets in haemostasis and thrombosis. Nature 413: 74-78, 2001.
2134. Faiyaz-UI-Haque, M.; Ahmad, W.; Zaidi, S. H. E.; Haque, S.; Teebi, A. S.; Ahmad, M.; Cohn, D. H.; Tsui, L. C.: Mutation in the cartilage-derived morphogenetic protein-1 (CDMP1) gene in a kindred affected with fibular hypoplasia and complex brachydactyly (DuPan syndrome). Clin. Genet. 61:454-458, 2002.
2135. Shapiro, M. B.; Senapathy, P.: RNA splice junctions of different classes of eukaryotes: sequence statistics and functional implications in gene expression. Nucleic Acids Res. 15: 7155-7174, 1987.
2136. Ishikawa, K.; Nagase, T.; Suyama, M.; Miyajima, N.; Tanaka, A.; Kotani, H.; Nomura, N.; Ohara, O.: Prediction of the coding sequences of unidentified human genes. X. The complete sequences of 100 new cDNA clones from brain which can code for large proteins in vitro. DNA Res. 5: 169-176, 1998.
2137. Kipreos, E. T.; Lander, L. E.; Wing, J. P.; He, W. W.; Hedgecock, E. M.: cul-1 is required for cell cycle exit in C. elegans and identifies a novel gene family. Cell 85: 829-839, 1996.
2138. Daugherty, B. L.; Springer, M. S.: The betachemokine receptorgenes CCR1 (CMKBR1), CCR2 (CMKBR2), and CCR3 (CMKBR3) cluster within 285 kb on human chromosome 3p21. Genomics 41: 294-295, 1997.
2139. Ferbus, D.; Le Chalony, C.; Prosperi, M.-T.; Muleris, M.; Vincent-Salomon, A.; Goubin, G.: Identification, nuclear localization, and binding activities of OZF, a human protein solely composed of zinc finger motifs. Europ. J. Biochem. 236: 991-995, 1996.
2140. Le Chalony, C.; Apiou, F.; Pibouin, L.; Dutrillaux, B.; Goubin, G.: Constitutive amplification of a zinc finger protein gene in cattle. DNA Cell Biol. 15: 83-88, 1996.
2141. Le Chalony, C.; Prosperi, M.-T.; Haluza, R.; Apiou, F.; Dutrillaux, B.; Goubin, G.: The OZF gene encodes a protein consisting essentially of zinc-finger motifs. J. Molec. Biol. 236: 399-404, 1994.
2142. Dhar, S. K.; Yoshida, K.; Machida, Y.; Khaira, P.; Chaudhuri, B.; Wohlschlegel, J. A.; Leffak, M.; Yates, J.; Dutta, A.: Replication from oriP of Epstein-Barr virus requires human ORC and is inhibited by geminin. Cell 106: 287-296, 2001.
2143. Gavin, K. A.; Hidaka, M.; Stillman, B.: Conserved initiator proteins in eukaryotes. Science 270: 1667-1671, 1995.
2144. Ohtani, K.; DeGregori, J.; Leone, G.; Herendeen, D. R.; Kelly, T. J.; Nevins, J. R.: Expression of the HsOrc1 gene, a human ORC1 homolog, is regulated by cell proliferation via the E2F transcription factor. Molec. Cell. Biol. 16: 6977-6984, 1996.
2145. Takahara, K.; Bong, M.; Brevard, R.; Eddy, R. L.; Haley, L. L.; Sait, S. J.; Shows, T. B.; Hoffman, G. G.; Greenspan, D. S.: Mouse and human homologues of the yeast origin of replication recognition complex subunit ORC2 and chromosomal localization of the cognate human gene ORC2L. Genomics 31: 119-122, 1996.
2146. Rowen, L.; Young, J.; Birditt, B.; Kaur, A.; Madan, A.; Philipps, D. L.; Qin, S.; Minx, P.; Wilson, R. K.; Hood, L.; Graveley, B. R.: Analysis of the human neurexin genes: alternative splicing and the generation of protein diversity. Genomics 79: 587-597, 2002.
2147. Tabuchi, K.; Sudhof, T. C.: Structure and evolution of neurexingenes: insight into the mechanism of alternative splicing. Genomics 79:849-859, 2002.
2148. Ullrich, B.; Ushkaryov, Y. A.; Sudhof, T. C.: Cartography of neurexins: more than 1000 isoforms generated by alternative splicing and expressed in distinct subsets of neurons. Neuron 14: 497-507, 1995.
2149. Ushkaryov, Y. A.; Petrenko, A. G.; Geppert, M.; Sudhof, T. C.: Neurexins: synaptic cell surface proteins related to the alpha-I atrotoxin receptor and laminin. Science 257: 50-56, 1992.
2150. Scheiffele, P.; Fan, J.; Choih, J.; Fetter, R.; Serafini, T.: Neuroligin expressed in nonneuronal cells triggers presynaptic development in contacting axons. Cell 101: 657-669, 2000.
2151. Cavaloc, Y.; Popielarz, M.; Fuchs, J.-P.; Gattoni, R.; Stevenin, J.: Characterization and cloning of the human splicing factor 9G8: a novel 35 kDa factor of the serine/arginine protein family. EMBO J. 13: 2639-2649, 1994.
2152. Popielarz, M.; Cavaloc, Y.; Mattei, M.-G.; Gattoni, R.; Stevenin, J.: The gene encoding human splicing factor 9G8: structure, chromosomal localization, and expression of alternatively processed transcripts. J. Biol. Chem. 270: 17830-17835, 1995.
2153. Wu, Q.; Zhang, T.; Cheng, J.-F.; Kim, Y.; Grimwood, J.; Schmutz, J.; Dickson, M.; Noonan, J. P.; Zhang, M. Q.; Myers, R. M.; Maniatis, T.: Comparative DNA sequence analysis of mouse and human protocadherin gene clusters. Genome Res. 11: 389-404, 2001.
2154. Aoki, K.; Inazawa, J.; Takahashi, T.; Nakahara, K.; Kasai, M.: Genomic structure and chromosomal localization of the gene encoding translin, a recombination hotspot binding protein. Genomics 43:237-241, 1997.
2155. Aoki, K.; Nakahara, K.; Ikegawa, C.; Seto, M.; Takahashi, T.; Minowada, J.; Strominger, J. L.; Maziarz, R. T.; Kasai, M.: Nuclear proteins binding to a novel target sequence within the recombination hotspotregions of Bcl-2 and the immunoglobulin D(H) gene family. Oncogene 9:1109-1115, 1994.
2156. Bodzioch, M.; Orso, E.; Klucken, J.; Langmann, T.; Bottcher, A.; Diederich, W.; Drobnik, W.; Barlage, S.; Buchler, C.; Porsch-Ozcurumez, M.; Kaminski, W. E.; Hahmann, H. W.; Oette, K.; Rothe, G.; Aslanidis, C.; Lackner, K. J.; Schmitz, G.: The gene encoding ATP-binding cassette-transporter 1 is mutated in Tangier disease. Nature Genet. 22: 347-351, 1999.
2157. Brooks-Wilson, A.; Marcil, M.; Clee, S. M.; Zhang, L.-H.; Roomp, K.; van Dam, M.; Yu, L.; Brewer, C.; Col- 2157. lins, J. A.; Molhuizen, H. O. F.; Loubser, O.; Ouelette, B. F. F.; and 14 others: Mutations in ABC1 in Tangier disease and familial high-density lipoprotein deficiency. Nature Genet. 22: 336-345, 1999.
2158. Remaley, A. T.; Rust, S.; Rosier, M.; Knapper, C.; Naudin, L.; Broccardo, C.; Peterson, K. M.; Koch, C.; Arnould, I.; Prades, C.; Duverger, N.; Funke, H.; Assman, G.; Dinger, M.; Dean, M.; Chimini, G.; Santamarina-Fojo, S.; Fredrickson, D. S.; Denefle, P. Brewer, H. B., Jr.: Human ATP-binding cassette transporter 1 (ABC1): genomic organization and identification of the genetic defect in the original Tangier disease kindred. Proc. Nat. Acad. Sci. 96: 12685-12690, 1999.
2159. Rust, S.; Rosier, M.; Funke, H.; Real, J.; Amoura, Z.; Piette, J.-C.; Deleuze, J.-F.; Brewer, H. B.; Duverger, N.; Denefle, P.; Assmann, G.: Tangier disease is caused by mutations in the gene encoding ATP-binding cassette transporter 1. Nature Genet. 22: 352-355, 1999.
2160. Young, S. G.; Fielding, C. J.: The ABCs of cholesterol efflux. Nature Genet. 22: 316-318, 1999.
2161. Delpire, E.; Lu, J.; England, R.; Dull, C.; Thorne, T.: Deafness and imbalance associated within activation of the secretory Na—K-2Clco-transporter. Nature Genet. 22: 192-195, 1999.
2162. Evans, R. L.; Park, K.; Turner, R. J.; Watson, G. E.; Nguyen, H.-V.; Dennett, M. R.; Hand, A. R.; Flagella, M.; Shull, G. E.; Melvin, J. E.: Severe impairment of salivation in Na+/K+/2Cl− cotransporter (NKCC1)-deficient mice. J. Biol. Chem. 275: 26720-26726, 2000.
2163. Payne, J. A.; Xu, J.-C.; Haas, M.; Lytle, C. Y.; Ward, D.; Forbush, B., III: Primary structure, functional expression, and chromosomal localization of the bumetanide-sensitive Na—K—Cl cotransporter inhuman colon. J. Biol. Chem. 270: 17977-17985, 1995.
2164. Quaggin, S. E.; Payne, J. A.; Forbush, B., III; Igarashi, P.: Localization of the renal Na—K—Cl cotransporter gene (Slc12a1) on mouse chromosome 2. Mammalian Genome 6: 557-561, 1995.
2165. Xu, J.-C.; Lytle, C.; Zhu, T. T.; Payne, J. A.; Benz, E., Jr.; Forbush, B., III: Molecular cloning and functional expression of the bumetanide-sensitive Na—K—Cl cotransporter. Proc. Nat. Acad. Sci. 91: 2201-2205, 1994.
2166. Sedlacek, Z.; Konecki, D. S.; Korn, B.; Klauck, S. M.; Poustka, A.: Evolutionary conservation and genomic organization of XAP-4, an Xq28 located gene coding for a human rab GDP-dissociation inhibitor (GDI). Mammalian Genome 5: 633-639, 1995.
2167. Sedlacek, Z.; Munstermann, E.; Mincheva, A.; Lichter, P.; Poustka, A.: The human rab GDI beta gene with long retroposon-rich introns maps to 10p15 and its pseudo-gene to 7p11-p13. Mammalian Genome 9:78-80, 1998.
2168. Cheng, Y.; Austin, S. C.; Rocca, B.; Koller, B. H.; Coffman, T. M.; Grosser, T.; Lawson, J. A.; FitzGerald, G. A.: Role of prostacyclinin the cardiovascular response to thromboxane A2. Science 296: 539-541, 2002.
2169. Ueno, S.; Maruki, Y.; Nakamura, M.; Tomemori, Y.; Kamae, K.; Tanabe, H.; Yamashita, Y.; Matsuda, S.; Kaneko, S.; Sano, A.: The gene encoding a newly discovered protein, chorein, is mutated in chorea-acanthocytosis. Nature Genet. 28: 121-122, 2001.
2170. Leone, G.; Sears, R.; Huang, E.; Rempel, R.; Nuckolls, F.; Park, C.-H.; Giangrande, P.; Wu, L.; Saavedra, H. I.; Field, S. J.; Thompson, M. A.; Yang, H.; Fujiwara, Y.; Greenberg, M. E.; Orkin, S.; Smith, C.; Nevins, J. R.: Myc requires distinct E2F activities to induce S phase and apoptosis. Molec. Cell 8: 105-113, 2001.
2171. Cheng, S. Y.; Gong, Q. H.; Parkinson, C.; Robinson, E. A.; Appella, E.; Merlino, G. T.; Pastan, I.: The nucleotide sequence of a human cellular thyroid hormone-binding protein present in endoplasmic reticulum. J. Biol. Chem. 262: 11221-11227, 1987.
2172. Koivu, J.; Myllyla, R.; Halaakoski, T.; Pihlajaniemi, T.; Tasanen, K.; Kivirikko, K. I.: A single polypeptide acts both as the beta subunit of prolyl 4-hydroxylase and as a protein disulfide-isomerase. J. Biol. Chem. 262: 6447-6449, 1987.
2173. Morris, J. I.; Varandani, P. T.: Characterization of a cDNA for human glutathione-insulin transhydrogenase (protein-disulfide isomerase/oxidoreductase). Biochim. Biophys. Acta 949: 169-180, 1988.
2174. Noiva, R.; Lennarz, W. J.: Protein disulfide isomerase: a multifunctional protein resident in the lumen of the endoplasmic reticulum. J. Biol. Chem. 267: 3553-3556, 1992.
2175. Pajunen, L.; Hoyhtya, M.; Tryggvason, K.; Kivirikko, K. I.; Myllyla, R.: Species-specific antibodies in the assignment of the gene for the beta-subunit of human prolyl 4-hydroxylase. (Abstract) Cytogenet. Cell Genet. 40: 719 only, 1985.
2176. Pajunen, L.; Jones, T. A.; Goddard, A.; Sheer, D.; Solomon, E.; Pihlajaniemi, T.; Kivirikko, K. I.: Regional assignment of the human gene coding for a multifunctional polypeptide (P4HB) acting as the beta-subunit of prolyl 4-hydroxylase and the enzyme protein disulfide isomerase to 17q25. Cytogenet. Cell Genet. 56: 165-168, 1991.
2177. Pajunen, L.; Myllyla, R.; Helaakoski, T.; Pihlajaniemi, T.; Tasanen, K.; Hoyhtya, M.; Tryggvason, K.; Solomon, E.; Kivirikko, K. I.: Assignment of the gene coding for both the beta-subunit of prolyl 4-hydroxylase and protein disulphide isomerase to human chromosome region 17q23-25. (Abstract) Cytogenet. Cell Genet. 46: 674 only, 1987.
2178. Pajunen, L.; Myllyla, R.; Helaakoski, T.; Pihlajaniemi, T.; Tasanen, K.; Hoyhtya, M.; Tryggvason, K.; Solomon, E.; Kivirikko, K. I.: Assignment of the gene coding for both the beta-subunit of prolyl 4-hydroxylase and the enzyme disulfide isomerase to human chromosome region 17p11-qter. Cytogenet. Cell Genet. 47: 37-41, 1988.
2179. Pihlajaniemi, T.; Helaakoski, T.; Tasanen, K.; Myllyla, R.; Huhtala, M.-L.; Koivu, J.; Kivirikko, K. I.: Molecular cloning of the beta-subunit of human prolyl 4-hydroxylase: this subunit and protein disulphide isomerase are products of the same gene. EMBO J. 6: 643-649, 1987.
2180. Popescu, N. C.; Cheng, S.; Pastan, I.: Chromosomal localization of the gene for a human thyroid hormone-binding protein. Am. J. Hum. Genet. 42: 560-564, 1988.
2181. Tasanen, K.; Parkkonen, T.; Chow, L. T.; Kivirikko, K. I.; Pihlajaniemi, T.: Characterization of the human gene for a polypeptide that acts both as the beta-subunit of prolyl 4-hydroxylase and as protein disulfide isomerase. J. Biol. Chem. 263: 16218-16224, 1988.
2182. Kelly, A.; Powis, S. H.; Glynne, R.; Radley, E.; Beck, S.; Trowsdale, J.: Second proteasome-related gene in the human MHC class II region. Nature 353:667-668, 1991.
2183. Martinez, C. K.; Monaco, J. J.: Homology of proteasome subunits to a major histocompatibility complex-linked LMP gene. Nature 353:664-667, 1991.
2184. Petes, T. D.: Meiotic recombination hot spots and cold spots. Nature Rev. Genet. 2: 360-369, 2001.
2185. Van Kaer, L.; Ashton-Rickardt, P. G.; Eichelberger, M.; Gaczynska, M.; Nagashima, K.; Rock, K. L.; Goldberg, A. L.; Doherty, P. C.; Tonegawa, S.: Altered peptidase and viral-specific T cell response in LMP2 mutant mice. Immunity 1: 533-541, 1994.

2186. Zhou, P.; Zanelli, E.; Smart, M.; David, C.: Genomic organization and tissue expression of mouse proteasome gene Lmp-2. Genomics 16:664-668, 1993.

2187. Doolittle, R. F.; Hunkapiller, M. W.; Hood, L. E.; Devare, S. G.; Robbins, K. C.; Aaronson, S. A.; Antoniades, H. N.: Simian sarcomavirus onc gene, v-sis, is derived from the gene (or genes) encoding a platelet-derived growth factor. Science 221: 275-277, 1983.

2188. Gardner, T. L.; Elston, D. M.; Wotowic, P. J.: A familial dermatofibrosarcoma protuberans. J. Am. Acad. Derm. 39: 504-505, 1998.

2189. Groffen, J.; Heisterkamp, N.; Stephenson, J. R.; Geurts van Kessel, A.; de Klein, A.; Grosveld, G.; Bootsma, D.: c-sis is translocated from chromosome 22 to chromosome 9 in chronic myelocytic leukemia. J. Exp. Med. 158: 9-15, 1983.

2190. Hermansson, M.; Nister, M.; Betsholtz, C.; Heldin, C.-H.; Westermark, B.; Funa, K.: Endothelial cell hyperplasia in human glioblastoma: coexpression of mRNA for platelet-derived growth factor (PDGF) B chain and PDGF receptor suggests autocrine growth stimulation. Proc. Nat. Acad. Sci. 85: 7748-7752, 1988.

2191. Josephs, S. F.; Dalla-Favera, R.; Gelmann, E. P.; Gallo, R. C.; Wong-Staal, F.: 5-prime viral and human cellular sequences corresponding to the transforming gene of simian sarcoma virus. Science 219: 503-505, 1983.

2192. Josephs, S. F.; Guo, C.; Ratner, L.; Wong-Staal, F.: Human proto-oncogene nucleotide sequences corresponding to the transforming region of simiansarcoma virus. Science 223: 487-491, 1984.

2193. Josephs, S. F.; Ratner, L.; Clarke, M. F.; Westin, E. H.; Reitz, M. S.; Wong-Staal, F.: Transforming potential of human c-sis nucleotide sequences encoding platelet-derived growth factor. Science 225:636-639, 1984.

2194. Kelly, J. D.; Raines, E. W.; Ross, R.; Murray, M. J.: The B chain of PDGF alone is sufficient for mitogenesis. EMBO J. 4: 3399-3405, 1985.

2195. Kiuru-Kuhlefelt, S.; El-Rifai, W.; Fanburg-Smith, J.; Kere, J.; Miettinen, M.; Knuutila, S.: Concomitant DNA copy number amplification at 17q and 22q in dermatofibrosarcoma protuberans. Cytogenet. Cell Genet. 92: 192-195, 2001.

2196. Kozak, C. A.; Sears, J. F.; Hoggan, M. D.: Genetic mapping of the mouse proto-oncogene c-sis to chromosome 15. Science 221: 867-869, 1983.

2197. Lindahl, P.; Johansson, B. R.; Leveen, P.; Betsholtz, C.: Pericyteloss and microaneurysm formation in PDGFB-deficient mice. Science 277:242-245, 1997.

2198. Owen, A. J.; Pantazis, P.; Antoniades, H. N.: Simian sarcomavirus-transformed cells secrete a mitogen identical to platelet-derived growth factor. Science 225: 54-56, 1984.

2199. Rao, C. D.; Igarashi, H.; Chiu, I.-M.; Robbins, K. C.; Aaronson, S. A.: Structure and sequence of the human csis/platelet-derived growth factor 2 (SIS/PDGF2) transcriptional unit. Proc. Nat. Acad. Sci. 83: 2392-2396, 1986.

2200. Robbins, K. C.; Antoniades, H. N.; Devare, S. G.; Hunkapiller, M. W.; Aaronson, S. A.: Structural and immunological similarities between simian sarcoma virus gene product(s) and human platelet-derived growth factor. Nature 305: 605-608, 1983.

2201. Robbins, K. C.; Devare, S. G.; Reddy, E. P.; Aaronson, S. A.: In vivo identification of the transforming gene product of simiansarcoma virus. Science 218: 1131-1133, 1982.

2202. Simon, M.-P.; Navarro, M.; Roux, D.; Pouyssegur, J.: Structural and functional analysis of a chimeric protein COL1A1-PDGFB generated by the translocation t(17;22) (q22;q13.1) in dermatofibrosarcoma protuberans (DP). Oncogene 20: 2965-2975, 2001.

2203. Smidt, M.; Kirsch, I.; Ratner, L.: Deletion of Alu sequences in the fifth c-sis intron in individuals with meningiomas. J. Clin. Invest. 86: 1151-1157, 1990.

2204. Turc-Carel, C.; Philip, I.; Berger, M. P.; Philip, T.; Lenoir, G. M.: Chromosomal translocations in Ewing's sarcoma. (Letter) New Eng. J. Med. 309: 497-498, 1983.

2205. Shimizu, A.; O'Brien, K. P.; Sjoblom, T.; Pietras, K.; Buchdunger, E.; Collins, V. P.; Heldin, C.-H.; Dumanski, J. P.; Ostman, A.: The dermatofibrosarcoma protuberans-associated collagen type I-alpha-1/platelet-derived growth factor (PDGF) beta-chain fusion gene generates a transforming protein that is processed to functional PDGF-BB. Cancer Res. 59:3719-3723, 1999.

2206. Simon, M.-P.; Pedeutour, F.; Sirvent, N.; Grosgeorge, J.; Minoletti, F.; Coindre, J.-M.; Terrier-Lacombe, M.-J.; Mandahl, N.; Craver, R. D.; Blin, N.; Sozzi, G.; Turc-Carel, C.; O'Brien, K. P.; Kedra, D.; Fransson, I.; Guilbaud, C.; Dumanski, J. P.: Deregulation of the platelet-derived growth factor B-chain gene via fusion with collagen gene COL1A1 in dermatofibrosarcoma protuberans and giant-cell fibroblastoma. Nature Genet. 15: 95-98, 1997.

2207. Waterfield, M. D.; Scrace, G. T.; Whittle, N.; Stroobant, P.; Johnsson, A.; Wasteson, A.; Westermark, B.; Heldin, C.-H.; Huang, J. S.; Deuel, T. F.: Platelet-derived growth factor is structurally related to the putative transforming protein p28(sis) of simian sarcomavirus. Nature 304: 35-39, 1983.

2208. Gimona, M.; Small, J. V.; Moeremans, M.; Van Damme, J.; Puype, M.; Vandekerckhove, J.: Porcine vinculin and metavinculin differ by a 68-residue insert located close to the carboxy-terminal part of the molecule. EMBO J. 7: 2329-2334, 1988.

2209. Lee, F. S.; Fox, E. A.; Zhou, H.-M.; Strydom, D. J.; Vallee, B. L.: Primary structure of human placental ribonuclease inhibitor. Biochemistry 27:8545-8553, 1988.

2210. Weremowicz, S.; Fox, E. A.; Morton, C. C.; Vallee, B. L.: The placental ribonuclease inhibitor (RNH) gene is located on chromosome subband 11p15.5. Genomics 8: 717-721, 1990.

2211. Zneimer, S. M.; Crawford, D.; Schneider, N. R.; Beutler, B.: Mapping of the human ribonuclease inhibitor gene (RNH) to chromosome 11p15 by in situ hybridization. Genomics 8: 175-178, 1990.

2212. Klingensmith, J.; Nusse, R.; Perrimon, N.: The *Drosophila* segment polarity gene dishevelled encodes a novel protein required for response to wingless signal. Genes Dev. 8: 118-130, 1994.

2213. Bui, T. D.; Beier, D. R.; Jonssen, M.; Smith, K.; Dorrington, S. M.; Kaklamanis, L.; Kearney, L.; Regan, R.; Sussman, D. J.; Harris, A. L.: cDNA cloning of a human dishevelled DVL-3 gene, mapping to 3q27, and expression in human breast and colon carcinomas. Biochem. Biophys. Res. Commun. 239: 510-516, 1997.

2214. Cheng, Y.-S. E.; Patterson, C. E.; Staeheli, P.: Interferon-induced guanylate-binding proteins lack an N(T) KXD consensus motif and bind GMP in addition to GDP and GTP. Molec. Cell. Biol. 11: 4717-4725, 1991.

2215. Kumar, S.; Li, Q.; Dua, A.; Ying, Y.-K.; Bagchi, M. K.; Bagchi, I. C.: Messenger ribonucleic acid encoding interferon-inducible guanylate binding protein 1 is induced in human endometrium within the putative window of implantation. J. Clin. Endocr. Metab. 86: 2420-2427, 2001.

2216. Prochazka, M.; Staeheli, P.; Holmes, R. S.; Haller, O.: Interferon-induced guanylate-binding proteins: mapping of the murine Gbp-1 locus to chromosome 3. Virology 145: 273-279, 1985.

2217. Strehlow, I.; Lohmann-Matthes, M. L.; Decker, T.: The interferon-inducible GBP1 gene: structure and mapping to human chromosome 1. Gene 144:295-299, 1994.

2218. Aoki, K.; Suzuki, K.; Sugano, T.; Tasaka, T.; Nakahara, K.; Kuge, O.; Omori, A.; Kasai, M.: A novel gene, 'Translin,' encodes a recombination hotspot binding protein associated with chromosomal translocations. Nature Genet. 10: 167-174, 1995.

2219. Badge, R. M.; Yardley, J.; Jeffreys, A. J.; Armour, J. A. L.: Crossover breakpoint mapping identifies a subtelomeric hotspot formale meiotic recombination. Hum. Molec. Genet. 9: 1239-1244, 2000.

2220. Hosaka, T.; Kanoe, H.; Nakayama, T.; Murakami, H.; Yamamoto, H.; Nakamata, T.; Tsuboyama, T.; Oka, M.; Kasai, M.; Sasaki, M. S.; Nakamura, T.; Toguchida, J.: Translin binds to the sequences adjacent to the breakpoints of the TLS and CHOP genes in liposarcomas with translocation t(12;16). Oncogene 19: 5821-5825, 2000.

2221. Kasai, M.; Aoki, K.; Matsuo, Y.; Minowada, J.; Maziarz, R. T.; Strominger, J. L.: Recombination hotspot associated factors specifically recognize novel target sequences at the site of interchromosomal rearrangements in T-ALL patients with t(8;14)(q24;q11) and (t(1;14)(p32;q11). Int. Immun. 6: 1017-1025, 1994.

2222. Cirillo, L. A.; Lin, F. R.; Cuesta, I.; Friedman, D.; Jarnik, M.; Zaret, K. S.: Opening of compacted chromatin by early developmental transcription factors HNF3(FoxA) and GATA-4. Molec. Cell 9: 279-289, 2002.

2223. Braun-Dullaeus, R. C.; Mann, M. J.; Ziegler, A.; von der Leyen, H. E.; Dzau, V. J.: A novel role for the cyclin-dependent kinase inhibitor p27(Kip1) in angiotensin II-stimulated vascular smooth muscle cell hypertrophy. J. Clin. Invest. 104: 815-823, 1999.

2224. Carrano, A. C.; Eytan, E.; Hershko, A.; Pagano, M.: SKP2 is required for ubiquitin-mediated degradation of the CDK inhibitor p27. Nature Cell Biol. 1: 193-199, 1999.

2225. Di Cristofano, A.; De Acetis, M.; Koff, A.; Cordon-Cardo, C.; Pandolfi, P. P.: Pten and p27(KIP1) cooperate in prostate cancer tumor suppression in the mouse. Nature Genet. 27: 222-224, 2001.

2226. Fero, M. L.; Rivkin, M.; Tasch, M.; Porter, P.; Carow, C. E.; Firpo, E.; Polyak, K.; Tsai, L.-H.; Broudy, V.; Perlmutter, R. M.; Kaushansky, K.; Roberts, J. M.: A syndrome of multiorgan hyperplasia with features of gigantism, tumorigenesis, and female sterility in p27(Kip1)-deficient mice. Cell 85: 733-744, 1996.

2227. Buyse, I. M.; Shao, G.; Huang, S.: The retinoblastoma protein binds to RIZ, a zinc-finger protein that shares an epitope with the adenovirus E1A protein. Proc. Nat. Acad. Sci. 92: 4467-4471, 1995.

2228. Buyse, I. M.; Takahashi, E.; Huang, S.: Physical mapping of the retinoblastoma interacting zinc finger gene RIZ to D1S228 on chromosome 1p36. Genomics 34: 119-121, 1996.

2229. Chadwick, R. B.; Jiang, G.-L.; Bennington, G. A.; Yuan, B.; Johnson, C. K.; Stevens, M. W.; Niemann, T. H.; Peltomaki, P.; Huang, S.; dela Chapelle, A.: Candidate tumor suppressor RIZ is frequently involved in colorectal carcinogenesis. Proc. Nat. Acad. Sci. 97: 2662-2667, 2000.

2230. Mock, B. A.; Coleman, M. P.; Huang, S.: Riz maps to distal chromosome 4 near genes involved in tumorigenesis and nerve degeneration. Mammalian Genome 7: 637 only, 1996.

2231. Poetsch, M.; Dittberner, T.; Woenckhaus, C.: Frameshift mutations of RIZ, but no point mutations in RIZ1 exons in malignant melanomas with deletions in 1p36. Oncogene 21: 3038-3042, 2002.

2232. Malek, N. P.; Sundberg, H.; McGrew, S.; Nakayama, K.; Kyriakidis, T. R.; Roberts, J. M.: A mouse knock-in model exposes sequential proteolytic pathways that regulate p27(Kip1) in G1 and S phase. Nature 413:323-327, 2001.

2233. Martin, E.; Cacheux, V.; Cave, H.; Lapierre, J. M.; Le\Paslier, D.; Grandchamp, B.: Localization of the CDKN4/p27(Kip1) gene to human chromosome 12p12.3. Hum. Genet. 96: 668-670, 1995.

2234. Mitsuhashi, T.; Aoki, Y.; Eksioglu, Y. Z.; Takahashi, T.; Bhide, P. G.; Reeves, S. A.; Caviness, V. S., Jr.: Overexpression of p27(Kip1) lengthens the G1 phase in a mouse model that targets inducible gene expression to central nervous system progenitor cells. Proc. Nat. Acad. Sci. 98: 6435-6440, 2001.

2235. Polyak, K.; Lee, M.-H.; Erdjument-Bromage, H.; Koff, A.; Roberts, J. M.; Tempst, P.; Massague, J.: Cloning of p27(Kip1), a cyclin-dependent kinase inhibitor and a potential mediator of extracellular antimitogenic signals. Cell 78: 59-66, 1994.

2236. Saito, T.; Seki, N.; Hattori, A.; Hayashi, A.; Abe, M.; Araki, R.; Fujimori, A.; Fukumura, R.; Kozuma, S.; Matsuda, Y.: Structure, expression profile, and chromosomal location of a mouse gene homologous to human DNA-PK (cs) interacting protein (KIP) gene. Mammalian Genome 10:315-317, 1999.

2237. Sherr, C. J.; Roberts, J. M.: Inhibitors of mammalian G1 cyclin-dependent kinases. Genes Dev. 9: 1149-1163, 1995.

2238. Toyoshima, H.; Hunter, T.: p27, a novel inhibitor of G1 cyclin-Cdk protein kinase activity, is related to p21. Cell 78: 67-74, 1994.

2239. Druck, T.; Gu, Y.; Prabhala. G.; Cannizzaro, L. A.; Park, S.-H.; Huebner, K.; Keen, J. H.: Chromosome localization of human genes for clathrin adaptor polypeptides AP2-beta and AP50 and the clathrin-binding protein, VCP. Genomics 30: 94-97, 1995.

2240. Ponnambalam, S.; Robinson, M. S.; Jackson, A. P.; Peiperl, L.; Parham, P.: Conservation and diversity in families of coated vesicle adaptins. J. Biol. Chem. 265: 4814-4820, 1990.

2241. Kaneko-Ishino, T.; Kuroiwa, Y.; Miyoshi, N.; Kohda, T.; Suzuki, R.; Yokoyama, M.; Viville, S.; Barton, S. C.; Ishino, F.; Surani, M. A.: Peg1/Mest imprinted gene on chromosome 6 identified by cDNA subtraction hybridization. Nature Genet. 11: 52-59, 1995.

2242. Kobayashi, S.; Kohda, T.; Miyoshi, N.; Kuroiwa, Y.; Aisaka, K.; Tsutsumi, O.; Kaneko-Ishino, T.; Ishino, F.: Human PEG1/MEST, an imprinted gene on chromosome 7. Hum. Molec. Genet. 6: 781-786, 1997.

2243. Kosaki, K.; Kosaki, R.; Craigen, W. J.; Matsuo, N.: Isoform-specific imprinting of the human PEG1/MEST gene. (Letter) Am. J. Hum. Genet. 66:309-312, 2000.

2244. Kotzot, D.; Schmitt, S.; Bernasconi, F.; Robinson, W. P.; Lurie, I. W.; Ilyina, H.; Mehes, K.; Hamel, B. C. J.; Otten, B. J.; Hergersberg, M.; Werder, E.; Shoenle, E.; Schinzel, A.: Uniparental disomy 7 in Silver-Russell syndrome and primordial growth retardation. Hum. Molec. Genet. 4: 583-587, 1995.

2245. Lefebvre, L.; Viville, S.; Barton, S. C.; Ishino, F.; Keverne, E. B.; Surani, M. A.: Abnormal maternal behaviour and growth retardation associated with loss of the imprinted gene Mest. Nature Genet. 20:163-169, 1998.

2246. Lefebvre, L.; Viville, S.; Barton, S. C.; Ishino, F.; Surani, M. A.: Genomic structure and parent-of-origin-specific methylation of Peg1. Hum. Molec. Genet. 6: 1907-1915, 1997.

2247. Ayala-Madrigal, M. L.; Doerr, S.; Ramirez-Duenas, M. L.; Hansmann, I.: Assignment of karyopherin alpha 1 (KPNA1) to human chromosome band 3q21 by in situ hybridization. Cytogenet. Cell Genet. 90: 58-59, 2000.

2248. Conti, E.; Uy, M.; Leighton, L.; Blobel, G.; Kuriyan, J.: Crystallographic analysis of the recognition of a nuclear localization signal by the nuclear import factor karyopherin alpha. Cell 94: 193-204, 1998.

2249. Cortes, P.; Ye, Z.-S.; Baltimore, D.: RAG-1 interacts with the repeated amino acid motif of the human homologue of the yeast protein SRP1. Proc. Nat. Acad. Sci. 91: 7633-7637, 1994.

2250. Barichard, F.; Joulin, V.; Henry, I.; Garel, M.-C.; Valentin, C.; Rosa, R.; Cohen-Solal, M.; Junien, C.: Chromosomal assignment of the human 2,3-bisphosphoglycerate mutase gene (BPGM) to region 7q34-7q22. Hum. Genet. 77: 283-285, 1987.

2251. Bowdler, A. J.; Prankerd, T. A. J.: Studies in congenital non-spherocytichaemolytic anaemias with specific enzyme defects. Acta Haemat. 31:65-78, 1964.

2252. Chen, S.-H.; Anderson, J. E.; Giblett, E. R.: 2,3-diphosphoglyceratemutase: its demonstration by electrophoresis and the detection of a genetic variant. Biochem. Genet. 5: 481-486, 1971.

2253. Galacteros, F.; Rosa, R.; Prehu, M. O.; Najean, Y.; Calvin, M. C.: Deficit en diphosphoglycerate mutase: nouveaux cas associes aune polyglobulie. Nouv. Rev. Franc. Hemat. 26: 69-74, 1984.

2254. Joulin, V.; Barichard, F.; Henry, I.; Garel, M. C.; Valentin, C.; Rosa, R.; Cohen-Solal, M.; Junien, C.: Chromosomal assignment of the human 2,3-bisphosphoglycerate mutase gene (BPGM) to region 7q22-7q34. (Abstract) Cytogenet. Cell Genet. 46: 635 only, 1987.

2255. Joulin, V.; Garel, M.-C.; Le Boulch, P.; Valentin, C.; Rosa, R.; Rosa, J.; Cohen-Solal, M.: Isolation and characterization of the human 2,3-bisphosphoglycerate mutase gene. J. Biol. Chem. 263: 15785-15790, 1988.

2256. Joulin, V.; Peduzzi, J.; Romeo, P.-H.; Rosa, R.; Valentin, C.; Dubart, A.; Lapeyre, B.; Blouquit, Y.; Garel, M.-C.; Goossens, M.; Rosa, J.; Cohen-Solal, M.: Molecular cloning and sequencing of the human erythrocyte 2,3-bisphosphoglycerate mutase cDNA: revised amino acid sequence. EMBO J. 5: 2275-2283, 1986.

2257. Labie, D.; Leroux, J.-P.; Najman, A.; Reyrolle, C.: Familial diphosphoglycerate mutase deficiency: influence on the oxygen affinity curves of hemoglobin. FEBS Lett. 9: 37-40, 1970.

2258. Lemarchandel, V.; Joulin, V.; Valentin, C.; Rosa, R.; Galacteros, F.; Rosa, J.; Cohen-Solal, M.: Compound heterozygosity in a complete erythrocyte bisphosphoglycerate mutase deficiency. Blood 80: 2643-2649, 1992.

2259. Rosa, R.; Audit, I.; Rosa, J.: Diphosphoglycerate mutase and 2,3-diphosphoglycerate phosphatase activities of red cells: comparative electrophoretic study. Biochem. Biophys. Res. Commun. 51: 536-542, 1973.

2260. Rosa, R.; Blouquit, Y.; Calvin, M.-C.; Prome, D.; Prome, J.-C.; Rosa, J.: Isolation, characterization, and structure of a mutant89 arg-to-cys bisphosphoglycerate mutase: implication of the active site in the mutation. J. Biol. Chem. 264: 7837-7843, 1989.

2261. Rosa, R.; Prehu, M.-O.; Beuzard, Y.; Rosa, J.: The first case of a complete deficiency of diphosphoglycerate mutase in human erythrocytes. J. Clin. Invest. 62: 907-915, 1978.

2262. Sasaki, R.; Ikura, K.; Sugimoto, E.; Chiba, H.: Purification of bisphosphoglyceromutase, 2,3-bisphosphoglycerate phosphatase and phosphoglyceromutase from human erythrocytes. Europ. J. Biochem. 50:581-593, 1975.

2263. Schroter, W.: Kongenitale nichtsphaerocytaere haemolytische Anaemiebei 2,3-Diphosphoglyceratmutasemangel der Erythrocyten im fruehen Saeuglingsalter. Klin. Wschr. 43: 1147-1153, 1965.

2264. Scott, E. M.; Wright, R. C.: An alternate method for demonstration of bisphosphoglyceromutase (DPGM) on starch gels. Am. J. Hum. Genet. 34:1013-1015, 1982.

2265. Yanagawa, S.; Hitomi, K.; Sasaki, R.; Chiba, H.: Isolation and characterization of cDNA encoding rabbit reticulocyte 2,3-bisphosphoglycerate synthase. Gene 44: 185-191, 1986.

2266. Hiesberger, T.; Trommsdorff, M.; Howell, B. W.; Goffinet, A.; Mumby, M. C.; Cooper, J. A.; Herz, J.: Direct binding of reelin to VLDL receptor and apoE receptor 2 induces tyrosine phosphorylation of disabled-1 and modulates tau phosphorylation. Neuron 24: 481-489, 1999.

2267. Trommsdorff, M.; Gotthardt, M.; Hiesberger, T.; Shelton, J.; Stockinger, W.; Nimpf, J.; Hammer, R. E.; Richardson, J. A.; Herz, J.: Reeler/Disabled-like disruption of neuronal migration in knockout mice lacking the VLDL-receptor and ApoE receptor 2. Cell 97: 689-701, 1999.

2268. Huebner, K.; Druck, T.; Croce, C. M.; Thiesen, H. J.: Twenty-seven nonoverlapping zinc finger cDNAs from human T cells map to nine different chromosomes with apparent clustering. Am. J. Hum. Genet. 48: 726-740, 1991.

2269. Rousseau-Merck, M.-F.; Hillion, J.; Jonveaux, P.; Couillin, P.; Seite, P.; Thiesen, H.-J.; Berger, R.: Chromosomal localization of 9 KOX zinc finger genes: physical linkages suggest clustering of KOX genes on chromosomes 12, 16, and 19. Hum. Genet. 92: 583-587, 1993.

2270. Lehmann, O. J.; El-ashry, M. F.; Ebenezer, N. D.; Ocaka, L.; Francis, P. J.; Wilkie, S. E.; Patel, R. J.; Ficker, L.; Jordan, T.; Khaw, P. T.; Bhattacharya, S. S.: A novel keratocan mutation causing autosomal recessive cornea plana. Invest. Ophthal. Vis. Sci. 42: 3118-3122, 2001.

2271. DiLella, A. G.: Chromosomal assignment of the human immunophilin FKBP-12 gene. Biochem. Biophys. Res. Commun. 179: 1427-1433, 1991.

2272. DiLella, A. G.; Hawkins, A.; Craig, R. J.; Schreiber, S. L.; Griffin, C. A.: Chromosomal band assignments of the genes encoding human FKBP12 and FKBP13. Biochem. Biophys. Res. Commun. 189: 819-823, 1992.

2273. Goebl, M. G.: The peptidyl-prolyl isomerase, FK506-binding protein, is most likely the 12 kd endogenous inhibitor 2 of protein kinase C. (Letter) Cell 64: 1051-1052, 1991.

2274. Jin, Y.-J.; Albers, M. W.; Lane, W. S.; Bierer, B. E.; Schreiber, S. L.; Burakoff, S. J.: Molecular cloning of a membrane-associated human FK506- and rapamycin-binding protein, FKBP-13. Proc. Nat. Acad. Sci. 88: 6677-6681, 1991.

2275. Maki, N.; Sekiguchi, F.; Nishimaki, J.; Miwa, K.; Hayano, T.; Takahashi, N.; Suzuki, M.: Complementary DNA encoding the human T-cell FK506-binding protein, a peptidylprolyl cis-trans isomerase distinct from cyclophilin. Proc. Nat. Acad. Sci. 87: 5440-5443, 1990.

2276. Peattie, D. A.; Hsaio, K.; Benasutti, M.; Lippke, J. A.: Three distinct messenger RNAs can encode the human immunosuppressant-binding protein FKBP12. Gene 150: 251-257, 1994.

2277. Shou, W.; Aghdasi, B.; Armstrong, D. L.; Guo, Q.; Bao, S.; Charng, M.-J.; Mathews, L. M.; Schneider, M. D.; Hamilton, S. L.; Matzuk, M. M.: Cardiac defects and altered ryanodine receptor function in mice lacking FKBP12. Nature 391: 489-492, 1998.

2278. Standaert, R. F.; Galat, A.; Verdine, G. L.; Schreiber, S. L.: Molecular cloning and overexpression of the human FK506-binding protein FKBP. Nature 346: 671-674, 1990.

2279. Wang, T.; Donahoe, P. K.; Zervos, A. S.: Specific interaction of type I receptors of the TGF-beta family with the immunophilin FKBP-12. Science 265:674-676, 1994.

2280. Martell, K. J.; Kwak, S.; Hakes, D. J.; Dixon, J. E.; Trent, J. M.: Chromosomal localization of four human VH1-like protein-tyrosine phosphatases. Genomics 22: 462-464, 1994.

2281. Bogenmann, E.; Lochrie, M. A.; Simon, M. I.: Cone cell-specificgenes expressed in retinoblastoma. Science 240: 76-78, 1988.

2282. Bonaiti-Pellie, C.; Briard-Guillemot, M. L.: Segregation analysisin hereditary retinoblastoma. Hum. Genet. 57: 411-419, 1981.

2283. Hunter, A. G. W.; Thompson, M. W.: Acromesomelic dwarfism: description of a patient and comparison with previously reported cases. Hum. Genet. 34: 107-113, 1976.

2284. Miceli-Richard, C.; Lesage, S.; Rybojad, M.; Prieur, A.-M.; Manouvrier-Hanu, S.; Hafner, R.; Chamaillard, M.; Zouali, H.; Thomas, G.; Hugot, J.-P.: CARD15 mutations in Blau syndrome. Nature Genet. 29: 19-20, 2001.

2285. Han, L. Wong, D.; Dhaka, A.; Afar, D.; White, M.; Xie, W.; Herschman, H.; Witte, O.: Colicelli, J.: Protein binding and signaling properties of RIN1 suggest a unique effector function. Proc. Nat. Acad. Sci. 94:4954-4959, 1997.

2286. Jhanwar, S. C.; Neel, B. G.; Hayward, W. S.; Chaganti, R. S. K.: Localization of the cellular oncogenes ABL, SIS, and FES on human germ-line chromosomes. Cytogenet. Cell Genet. 38: 73-75, 1984.

2287. Bao, S.; Tibbetts, R. S.; Brumbaugh, K. M.; Fang, Y.; Richardson, D. A.; Ali, A.; Chen, S. M.; Abraham, R. T.; Wang, X.-F.: ATR/ATM-mediatedphosphorylation of human Rad17 is required for genotoxic stress responses. Nature 411:969-974, 2001.

2288. Goedert, M.; Hasegawa, J.; Craxton, M.; Leversha, M. A.; Clegg, S.: Assignment of the human stress-activated protein kinase-3 gene (SAPK3) to chromosome 22q13.3 by fluorescence in situ hybridization. Genomics 41:501-502, 1997.

2289. Avraham, K. B.; Prezioso, V. R.; Chen, W. S.; Lai, E.; Sladek, F. M.; Zhong, W.; Darnell, J. E., Jr.; Jenkins, N. A.; Copeland, N. G.: Murine chromosomal location of four hepatocyte-enriched transcriptionfactors: HNF-3-alpha, HNF-3-beta, HNF-3-gamma, and HFN-4. Genomics 13:264-268, 1992.

2290. Kaestner, K. H.; Hiemisch, H.; Luckow, B.; Schutz, G.: The HNF-3 gene family of transcription factors in mice: gene structure, cDNAsequence, and mRNA distribution. Genomics 20: 377-385, 1994.

2291. Mincheva, A.; Lichter, P.; Schutz, G.; Kaestner, K. H.: Assignment of the human genes for hepatocyte nuclear factor 3-alpha, -beta, and -gamma (HNF3A, HNF3B, HNF3G) to 14q12-q13, 20p11, and 19q13.2-q13.4. Genomics 39:417-419, 1997.

2292. Adams, R. H.; Porras, A.; Alonso, G.; Jones, M.; Vintersten, K.; Panelli, S.; Valladares, A.; Perez, L.; Klein, R.; Nebreda, A. R.: Essential role of p38-alpha MAP kinase in placental but not embryoniccardiovascular development. Molec. Cell 6: 109-116, 2000.

2293. Ge, B.; Gram, H.; Di Padova, F.; Huang, B.; New, L.; Ulevitch, R. J.; Luo, Y.; Han, J.: MAPKK-independent activation of p38-alphamediated by TAB1-dependent autophosphorylation of p38-alpha. Science 295:1291-1294, 2002.

2294. Han, J.; Lee, J.-D.; Bibbs, L.; Ulevitch, R. J.: A MAP kinasetargeted by endotoxin and hyperosmolarity in mammalian cells. Science 265:808-811, 1994.

2295. Kim, D. H.; Feinbaum, R.; Alloing, G.; Emerson, F. E.; Garsin, D. A.; Inoue, H.; Tanaka-Hino, M.; Hisamoto, N.; Matsumoto, K.; Tan, M.-W.; Ausubel, F. M.: A conserved p38 MAP kinase pathway in *Caenorhabditis elegans* innate immunity. Science 297: 623-626, 2002.

2296. Kumar, S.; McLaughlin, M. M.; McDonnell, P. C.; Lee, J. C.; Livi, G. P.; Young, P. R.: Human mitogen-activated protein kinase CSBP1, but not CSBP2, complements a hog1 deletion in yeast. J. Biol. Chem. 270:29043-29046, 1995.

2297. Lee, J. C.; Laydon, J. T.; McDonnell, P. C.; Gallagher, T. F.; Kumar, S.; Green, D.; McNulty, D.; Blumenthal, M. J.; Heys, J. R.; Landvatter, S. W.; Stickler, J. E.; McLaughlin, M. M.; Siemens, I. R.; Fisher, S. M.; Livi, G. P.; White, J. R.; Adams, J. L.; Young, P. R.: A protein kinase involved in the regulation of inflammatorycytokine biosynthesis. Nature 372: 739-746, 1994.

2298. Liao, P.; Georgakopoulos, D.; Kovacs, A.; Zheng, M.; Lerner, D.; Pu, H.; Saffitz, J.; Chien, K.; Xiao, R.-P.; Kass, D. A.; Wang, Y.: The in vivo role of p38 MAP kinases in cardiac remodeling and restrictivecardiomyopathy. Proc. Nat. Acad. Sci. 98: 12283-12288, 2001.

2299. Maizels, E. T.; Mukherjee, A.; Sithanandam, G.; Peters, C. A.; Cottom, J.; Mayo, K. E.; Hunzicker-Dunn, M.: Developmental regulation of mitogen-activated protein kinase-activated kinases-2 and -3 (MAPKAPK-2/-3) in vivo during corpus luteum formation in the rat. Molec. Endocr. 15:716-733, 2001.

2300. McDonnell, P. C.; DiLella, A. G.; Lee, J. C.; Young, P. R.: Localization of the human stress responsive MAP kinase-like CSAIDs binding protein (CSBP) gene to chromosome 6p21.3/21.2. Genomics 29: 301-302, 1995.

2301. New, L.; Jiang, Y.; Zhao, M.; Liu, K.; Zhu, W.; Flood, L. J.; Kato, Y.; Parry, G. C. N.; Han, J.: PRAK, a novel protein kinaseregulated by the p38 MAP kinase. EMBO J. 17: 3372-3384, 1998.

2302. Ni, H.; Wang, X. S.; Diener, K.; Yao, Z.: MAPKAPK5, a novel mitogen-activated protein kinase (MAPK)-activated protein kinase, is a substrate of the extracellular-regulated kinase (ERK) and p38 kinase. Biochem. Biophys. Res. Commun. 243: 492-496, 1998.

2303. Takekawa, M.; Maeda, T.; Saito, H.: Protein phosphatase 2C-alphainhibits the human stress-responsive p38 and JNK MAPK pathways. EMBO J. 17: 4744-4752, 1998.

2304. Tamura, K.; Sudo, T.; Senftleben, U.; Dadak, A. M.; Johnson, R.; Karin, M.: Requirement for p38-alpha in erythropoietin expression: a role for stress kinases in erythropoiesis. Cell 102: 221-231, 2000.

2305. Haber, N.; Stengel, D.; Defer, N.; Roeckel, N.; Mattei, M.-G.; Hanoune, J.: Chromosomal mapping of human adenylyl cyclase genestype III, type V and type VI. Hum. Genet. 94: 69-73, 1994.

2306. Anand, A.; Chada, K.: In vivo modulation of Hmgic reduces obesity. Nature Genet. 24: 377-380, 2000.

2307. Arlotta, P.; Tai, A. K.-F.; Manfioletti, G.; Clifford, C.; Jay, G.; Ono, S. J.: Transgenic mice expressing a truncated form of the high mobility group I-C protein develop adiposity and an abnormallyhigh prevalence of lipomas. J. Biol. Chem. 275: 14394-14400, 2000.

2308. Ashar, H. R.; Cherath, L.; Przybysz, K. M.; Chada, K.: Genomiccharacterization of human HMGIC, a member of the accessory transcriptionfactor family found at translocation breakpoints in lipomas. Genomics 31:207-214, 1996.

2309. Ashar, H. R.; Schoenberg Fejzo, M.; Tkachenko, A.; Zhou, X.; Fletcher, J. A.; Weremowicz, S.; Morton, C. C.; Chada, K.: Disruption of the architectural factor HMGI-C: DNA-binding AT hook motifs fused in lipomas to distinct transcriptional regulatory domains. Cell 82: 57-65, 1995.

2310. Chau, K.-Y.; Patel, U. A.; Lee, K.-L. D.; Lam, H.-Y. P.; Crane-Robinson, C.: The gene for the human architectural transcription factor HMGI-Cconsists of five exons each coding for a distinct functional element. Nucleic Acids Res. 23: 4262-4266, 1995.

2311. Danforth, E., Jr.: Failure of adipocyte differentiation causestype II diabetes mellitus. Nature Genet. 26: 13 only, 2000.

2312. Friedmann, M.; Holth, L. T.; Zoghbi, H. Y.; Reeves, R.: Organization, inducible-expression and chromosome localization of the human HMG-I(Y) nonhistone protein gene. Nucleic Acids Res. 21: 4259-4267, 1993.

2313. Ishwad, C. S.; Shriver, M. D.; Lassige, D. M.; Ferrell, R. E.: The high mobility group I-C gene (HMGI-C): polymorphism and geneticlocalization. Hum. Genet. 99: 103-105, 1997.

2314. Kazmierczak, B.; Dal Cin, P.; Wanschura, S.; Bartnitzke, S.; Vanden Berghe, H.; Bullerdiek, J.: Cloning and molecular characterization of part of a new gene fused to HMGIC in mesenchymal tumors. Am. J. Path. 152: 431-435, 1998.

2315. Kazmierczak, B.; Pohnke, Y.; Bullerdiek, J.: Fusion transcriptsbetween the HMGIC gene and RTVL-H-related sequences in mesenchymaltumors without cytogenetic aberrations. Genomics 38: 223-226, 1996.

2316. Manfioletti, G.; Rustighi, A.; Mantovani, F.; Goodwin, G. H.; Giancotti, V.: Isolation and characterization of the gene coding for murine high-mobility-group protein HMGI-C. Gene 167: 249-253, 1995.

2317. Mine, N.; Kurose, K.; Nagai, H.; Doi, D.; Ota, Y.; Yoneyama, K.; Konishi, H.; Araki, T.; Emi, M.: Gene fusion involving HMGIC is afrequent aberration in uterine leiomyomas. J. Hum. Genet. 46: 408-412, 2001.

2318. Nucci, M. R.; Weremowicz, S.; Neskey, D. M.; Sornberger, K.; Tallini, G.; Morton, C. C.; Quade, B. J.: Chromosomal translocation t(8;12) induces aberrant HMGIC expression in aggressive angiomyxoma of the vulva. Genes Chromosomes Cancer 32: 172-176, 2001.

2319. Seimiya, H.; Sawabe, T.; Inazawa, J.; Tsuruo, T.: Cloning, expression and chromosomal localization of a novel gene for protein tyrosine phosphatase (PTP-U2) induced by various differentiation-inducing agents. Oncogene 10:1731-1738, 1995.

2320. Wiggins, R. C.; Wiggins, J. E.; Goyal, M.; Wharram, B. L.; Thomas, P. E.: Molecular cloning of cDNAs encoding human GLEPP1, a membranep rotein tyrosine phosphatase: characterization of the GLEPP1 protein distribution in human kidney and assignment of the GLEPP1 gene to human chromosome 12p12-p13. Genomics 27: 174-181, 1995.

2321. Jia, S.; Van Dusen, W. J.; Diehl, R. E.; Kohl, N. E.; Dixon, R. A. F.; Elliston, K. O.; Stern, A. M.; Friedman, P. A.: cDNA cloning and expression of bovine aspartyl (asparaginyl) beta-hydroxylase. J. Biol. Chem. 267: 14322-14327, 1992.

2322. Korioth, F.; Gieffers, C.; Frey, J.: Cloning and characterization of the human gene encoding aspartyl beta-hydroxylase. Gene 150:395-399, 1994.

2323. Lavaissiere, L.; Jia, S.; Nishiyama, M.; de la Monte, S.; Stern, A. M.; Wands, J. R.; Friedman, P. A.: Overexpression of human aspartyl(asparaginyl)-beta-hydroxylase in hepatocellular carcinoma and cholangiocarcinoma. J. Clin. Invest. 98:1313-1323, 1996.

2324. Lim, K. Y.; Hong, C.-S.; Kim, D. H.: cDNA cloning and characterization of human cardiac junctin. Gene 255: 35-42, 2000.

2325. Scott, A. F.: Personal Communication. Baltimore, Md. Feb. 19, 2001.

2326. Treves, S.; Feriotto, G.; Moccagatta, L.; Gambari, R.; Zorzato, F.: Molecular cloning, expression, functional characterization, chromosomal localization, and gene structure of junctate, a novel integral calcium binding protein of sarco(endo)plasmic reticulum membrane. J. Biol. Chem. 275: 39555-39568, 2000.

2327. Wetzel, G. T.; Ding, S.; Chen, F.: Molecular cloning of junctin from human and developing rabbit heart. Molec. Genet. Metab. 69:252-258, 2000.

2328. Vikkula, M.; Boon, L. M.; Carraway, K. L., III; Calvert, J. T.; Diamonti, A. J.; Goumnerov, B.; Pasyk, K. A.; Marchuk, D. A.; Warman, M. L.; Cantley, L. C.; Mulliken, J. B.; Olsen, B. R.: Vascular dysmorphogenesis caused by an activating mutation in the receptor tyrosine kinase TIE2. Cell 87:1181-1190, 1996.

2329. Barker, H. M.; Brewis, N. D.; Street, A. J.; Spurr, N. K.; Cohen, P. T. W.: Three genes for protein phosphatase 1 map to different human chromosomes: sequence, expression and gene localisation of protein serine/threonine phosphatase 1 beta (PPP1CB). Biochim. Biophys. Acta 1220: 212-218, 1994.

2330. Saadat, M.; Kakinoki, Y.; Mizuno, Y.; Kikuchi, K.; Yoshida, M. C.: Chromosomal localization of human, rat, and mouse protein phosphatase type 1 beta catalytic subunit genes (PPP1CB) by fluorescence in situ hybridization. Jpn. J. Genet. 69: 697-700, 1994.

2331. Becq, F.; Hamon, Y.; Bajetto, A.; Gola, M.; Verrier, B.; Chimini, G.: ABC1, an ATP binding cassette transporter required for phagocytosis of apoptotic cells, generates a regulated anion flux after expression in Xenopus laevis oocytes. J. Biol. Chem. 272: 2695-2699, 1997.

2332. Decottignies, A.; Goffeau, A.: Complete inventory of the yeast ABC proteins. Nature Genet. 15: 137-145, 1997.

2333. Guo, Z.; Inazu, A.; Yu, W.; Suzumura, T.; Okamoto, M.; Nohara, A.; Higashikata, T.; Sano, R.; Wakasugi, K.; Hayakawa, T.; Yoshida, K.; Suchiro, T.; Schmitz, G.; Mabuchi, H.: Double deletions and missense mutations in the first nucleotide-binding fold of the ATP-binding cassette transporter A1 (ABCA1) gene in Japanese patients with Tangier disease. J. Hum. Genet. 47: 325-329, 2002.

2334. Hong, S. H.; Rhyne, J.; Zeller, K.; Miller, M.: Novel ABCA1 compound variant associated with HDL cholesterol deficiency. Biochim. Biophys. Acta 1587: 60-64, 2002.

2335. Huang, W.; Moriyama, K.; Koga, T.; Hua, H.; Ageta, M.; Kawabata, S.; Mawatari, K.; Imamura, T.; Eto, T.; Kawamura, M.; Teramoto, T.; Sasaki, J.: Novel mutations in ABCA1 gene in Japanese patients with Tangier disease and familial high density lipoprotein deficiency with coronary heart disease. Biochim. Biophys. Acta 1537: 71-78, 2001.

2336. Ishii, J.; Nagano, M.; Kujiraoka, T.; Ishihara, M.; Egashira, T.; Takada, D.; Tsuji, M.; Hattori, H.; Emi, M.: Clinical variant of Tangier disease in Japan: mutation of the ABCA1 gene in hypoalphalipoproteinemia with corneal lipidosis. J. Hum. Genet. 47: 366-369, 2002.

2337. Jennings, M. W.; Jones, R. W.; Wood, W. G.; Weatherall, D. J.: Analysis of an inversion within the human beta globin gene cluster. Nucleic Acids Res. 13: 2897-2906, 1985.

2338. Kulozik, A. E.; Bellan-Koch, A.; Kohne, E.; Kleihauer, E.: A deletion/inversion rearrangement of the beta-globin gene cluster in a Turkish family with delta-beta(0)-thalassemia intermedia. Blood 79:2455-2459, 1992.

2339. Langmann, T.; Klucken, J.; Reil, M.; Liebisch, G.; Luciani, M.-F.; Chimini, G.; Kaminski, W. E.; Schmitz, G.: Molecular cloning of the human ATP-binding cassette transporter 1 (hABC1): evidence for sterol-dependent regulation in macrophages. Biochem. Biophys. Res. Commun. 257: 29-33, 1999.

2340. Lawn, R. M.; Wade, D. P.; Garvin, M. R.; Wang, X.; Schwartz, K.; Porter, J. G.; Seilhamer, J. J.; Vaughan, A. M.; Oram, J. F.: The Tangier disease gene product ABC1 controls the cellular apolipoprotein-mediated lipid removal pathway. J. Clin. Invest. 104: R25-R31, 1999.

2341. Luciani, M. F.; Denizot, F.; Savary, S.; Mattei, M. G.; Chimini, G.: Cloning of two novel ABC transporters mapping on human chromosome 9. Genomics 21: 150-159, 1994.

2342. Lapicka-Bodzioch, K.; Bodzioch, M.; Krull, M.; Kielar, D.; Probst, M.; Kiec, B.; Andrikovics, H.; Bottcher, A.; Hubacek, J.; Aslanidis, C.; Suttorp, N.; Schmitz, G.: Homogeneous assay based on 52 primer sets to scan for mutations of the ABCA1 gene and its application in genetic analysis of a new patient with familial high-density lipoprotein deficiency syndrome. Biochim. Biophys. Acta 1537: 42-48, 2001.

2343. Marcil, M.; Boucher, B.; Krimbou, L.; Solymoss, B. C.; Davignon, J.; Frohlich, J.; Genest, J., Jr.: Severe familial HDL deficiency in French-Canadian kindreds: clinical, biochemical, and molecular characterization. Arterioscler. Thromb. Vasc. Biol. 15: 1015-1024, 1995.

2344. Marcil, M.; Yu, L.; Krimbou, L.; Boucher, B.; Oram, J. F.; Cohn, J. S.; Genest, J., Jr.: Cellular cholesterol transport and efflux in fibroblasts are abnormal in subjects with familial HDL deficiency. Arterioscler. Thromb. Vasc. Biol. 19: 159-169, 1999.

2345. McNeish, J.; Aiello, R. J.; Guyot, D.; Turi, T.; Gabel, C.; Aldinger, C.; Hoppe, K. L.; Roach, M. L.; Royer, L. J.; de Wet, J.; Broccardo, C.; Chimini, G.; Francone, O. L.: High density lipoprotein deficiency and foam cell accumulation in mice with targeted disruption of ATP-binding cassette transporter-1. Proc. Nat. Acad. Sci. 97: 4245-4250, 2000.

2346. Pullinger, C. R.; Hakamata, H.; Duchateau, P. N.; Eng, C.; Aouizerat, B. E.; Cho, M. H.; Fielding, C. J.; Kane, J. P.: Analysis of hABC1 gene 5-prime end: additional peptide sequence, promoter region, and four polymorphisms. Biochem. Biophys. Res. Commun. 271: 451-455, 2000.

2347. Petit, M. M. R.; Schoenmakers, E. F. P. M.; Huysmans, C.; Geurts, J. M. W.; Mandahl, N.; Van de Ven, W. J. M.: LHFP, a novel translocation partner gene of HMGIC in a lipoma, is a member of a new family of LHFP-like genes. Genomics 57: 438-441, 1999.

2348. Nishita, Y.; Yoshida, I.; Sado, T.; Takagi, N.: Genomic imprinting and chromosomal localization of the human MEST gene. Genomics 36:539-542, 1996.

2349. Orso, E.; Broccardo, C.; Kaminski, W. E.; Bottcher, A.; Liebisch, G.; Drobnik, W.; Gotz, A.; Chambenoit, O.; Diederich, W.; Langmann, T.; Spruss, T.; Luciani, M.-F.; Rothe, G.; Lackner, K. J.; Chimini, G.; Schmitz, G.: Transport of lipids from Golgi to plasma membrane is defective in Tangier disease patients and Abcl-deficient mice. Nature Genet. 24: 192-196, 2000.

2350. Ahrendt, S. A.; Decker, P. A.; Alawi, E. A.; Zhu, Y.; Sanchez-Cespedes, M.; Yang, S. C.; Haasler, G. B.; Kajdacsy-Balla, A.; Demeure, M. J.; Sidransky, D.: Cigarette smoking is strongly associated with mutation of the K-ras gene in patients with primary adenocarcinoma of the lung. Cancer 92:1525-1530, 2001.

2351. Almoguera, C.; Shibata, D.; Forrester, K.; Martin, J.; Arnheim, N.; Perucho, M.: Most human carcinomas of the exocrine pancreas contain mutant c-K-ras genes. Cell 53: 549-554, 1988.

2352. Andreyev, H. J. N.; Tilsed, J. V. T.; Cunningham, D.; Sampson, S. A.; Norman, A. R.; Schneider, H. J.; Clarke, P. A.: K-ras mutations in patients with early colorectal cancers. Gut 41: 323-329, 1997.

2353. Bollag, G.; Adler, F.; elMasry, N.; McCabe, P. C.; Connor, E. Jr.; Thompson, P.; McCormick, F.; Shannon, K.: Biochemical characterization of a novel KRAS insertion mutation from a human leukemia. J. Biol. Chem. 271: 32491-32494, 1996.

2354. Burmer, G. C.; Loeb, L. A.: Mutations in the KRAS2 oncogene during progressive stages of human colon carcinoma. Proc. Nat. Acad. Sci. 86:2403-2407, 1989.

2355. Capon, D. J.; Seeburg, P. H.; McGrath, J. P.; Hayflick, J. S.; Edman, U.; Levinson, A. D.; Goeddel, D. V.: Activation of Ki-ras2 gene in human colon and lung carcinomas by two different point mutations. Nature 304:507-513, 1983.

2356. Cubilla, A. L.; Fitzgerald, P. J.: Cancer Res. 36: 2690-2698, 1976.

2357. Der, C. J.; Cooper, G. M.: Altered gene products are associated with activation of cellular ras-k genes in human lung and colon carcinomas. Cell 32:201-208, 1983.

2358. Feig, L. A.; Bast, R. C., Jr.; Knapp, R. C.; Cooper, G. M.: Somatic activation of ras-K gene in a human ovarian carcinoma. Science 223:698-701, 1984.

2359. Grimmond, S. M.; Raghavan, D.; Russell, P. J.: Detection of a rare point mutation in Ki-ras of a human bladder cancer xenograft by polymerase chain reaction and direct sequencing. Urol. Res. 20:121-126, 1992.

2360. Hayashi, N.; Sugai, S.; Ito, I.; Nakamori, S.; Ogawa, M.; Nakamura, Y.: Ethnic difference in the pattern of K-ras oncogene mutations in human colorectal cancers. Hum. Mutat. 8: 258-261, 1996.

2361. Marx, S. O.; Reiken, S.; Hisamatsu, Y.; Jayaraman, T.; Burkhoff, D.; Rosemblit, N.; Marks, A. R.: PKA phosphorylation dissociates FKBP12.6 from the calcium release channel (ryanodine receptor): defective regulation in failing hearts. Cell 101: 365-376, 2000.

2362. Albrecht, B.; Weber, K.; Pongs, O.: Characterization of a voltage-activated K-channel gene cluster on human chromosome 12p13. Receptors Channels 3:213-220, 1995.

2363. Grupe, A.; Schroter, K. H.; Ruppersberg, J. P.; Stocker, M.; Drewes, T.; Beckh, S.; Pongs, O.: Cloning and expression of a human voltage-gated potassium channel: a novel member of the RCK potassium channel family. EMBO J. 9: 1749-1756, 1990.

2364. Klocke, R.; Roberds, S. L.; Tamkun, M. M.; Gronemeier, M.; Augustin, A.; Albrecht, B.; Pongs, O.; Jockusch, H.: Chromosomal mapping in the mouse of eight K(+)-

2364. channel genes representing the four Shaker-like subfamilies Shaker, Shab, Shaw, and Shal. Genomics 18: 568-574, 1993.

2365. Kiefer, M. C.; Tucker, J. E.; Joh, R.; Landsberg, K. E.; Saltman, D.; Barr, P. J.: Identification of a second human subtilisin-like protease gene in the fes/fps region of chromosome 15. DNA Cell Biol. 10:757-769, 1991.

2366. Orth, K.; Palmer, L. E.; Bao, Z. Q.; Stewart, S.; Rudolph, A. E.; Bliska, J. B.; Dixon, J. E.: Inhibition of the mitogen-activated protein kinase kinase superfamily by a Yersinia effector. Science 285:1920-1923, 1999.

2367. Rampoldi, L.; Zimbello, R.; Bortoluzzi, S.; Tiso, N.; Valle, G.; Lanfranchi, G.; Danieli, G. A.: Chromosomal localization of four MAPK signaling cascade genes: MEK1, MEK3, MEK4 and MEKK5. Cytogenet. Cell Genet. 78: 301-303, 1997.

2368. Collu, R.; Tang, J.; Castagne, J.; Lagace, G.; Masson, N.; Huot, C.; Deal, C.; Delvin, E.; Faccenda, E.; Eidne, K. A.; Van Vliet, G.: A novel mechanism for isolated central hypothyroidism: inactivating mutations in the thyrotropin-releasing hormone receptor gene. J. Clin. Endocr. Metab. 82: 1361-1365, 1997.

2369. Katsanis, N.; Fitzgibbon, J.; Fisher, E. M. C.: Paralogy mapping: identification of a region in the human MHC triplicated onto human chromosomes 1 and 9 allows the prediction and isolation of novel PBX and NOTCH loci. Genomics 35: 101-108, 1996.

2370. Rohen, C.; Caselitz, J.; Stern, C.; Wanschura, S.; Schoenmakers, E. F.; Van de Ven, W. J.; Barnitzke, S.; Bullerdiek, J.: A hamartoma of the breast with an aberration of 12q mapped to the MAR region by fluorescence in situ hybridization. Genes Chromosomes Cancer 84:82-84, 1995.

2371. Schoenmakers, E. F. P. M.; Huysmans, C.; Van de Ven, W. J. M.: Allelic knockout of novel splice variants of human recombination repair gene RAD51B in t(12;14) uterine leiomyomas. Cancer Res. 59:19-23, 1999.

2372. Zhou, X.; Benson, K. F.; Ashar, H. R.; Chada, K.: Mutation responsible for the mouse pygmy phenotype in the developmentally regulated factor HMGI-C. Nature 377: 771-774, 1995.

2373. Holash, J.; Maisonpierre, P. C.; Compton, D.; Boland, P.; Alexander, C. R.; Zagzag, D.; Yancopoulos, G. D.; Wiegand, S. J.: Vessel cooption, regression, and growth in tumors mediated by angiopoietins and VEGF. Science 284: 1994-1998, 1999.

2374. Thurston, G.; Suri, C.; Smith, K.; McClain, J.; Sato, T. N.; Yancopoulos, G. D.; McDonald, D. M.: Leakage-resistant blood vessels in mice transgenically overexpressing angiopoietin-1. Science 286: 2511-2514, 1999.

2375. Rampoldi, L.; Dobson-Stone, C.; Rubio, J. P.; Danek, A.; Chalmers, R. M.; Wood, N. W.; Verellen, C.; Ferrer, X.; Malandrini, A.; Fabrizi, G. M.; Brown, R.; Vance, J.; Pericak-Vance, M.; Rudolf, G.; Carre, S.; Alonso, E.; Manfredi, M.; Nemeth, A. H.; Monaco, A. P.: A conserved sorting-associated protein is mutant in chorea-acanthocytosis. Nature Genet. 28: 119-120, 2001.

2376. Wong-Staal, F.; Dalla-Favera, R.; Franchini, G.; Gelmann, E. P.; Gallo, R. C.: Three distinct genes in human DNA related to the transforming genes of mammalian sarcoma retroviruses. Science 213: 226-228, 1981.

2377. Aurias, A.; Rimbaut, C.; Buffe, D.; Dubousset, J.; Mazabraud, A.: Chromosomal translocations in Ewing's sarcoma. (Letter) New Eng. J. Med. 309: 496-497, 1983.

2378. Bartram, C. R.; de Klein, A.; Hagemeijer, A.; Grosveld, G.; Heisterkamp, N.; Groffen, J.: Localization of the human c-sis oncogene in Ph-1-positive and Ph-1-negative chronic myelocytic leukemia by in situ hybridization. Blood 63:223-225, 1984.

2379. Bechet, J.-M.; Bornkamm, G.; Freese, U.-K.; Lenoir, G. M.: Thec-sis oncogene is not activated in Ewing's sarcoma. (Letter) New Eng. J. Med. 310: 393 only, 1984.

2380. Bishop, J. M.: Enemies within: the genesis of retrovirus oncogenes. Cell 23:5-6, 1981.

2381. Bolger, G. B.; Stamberg, J.; Kirsch, I. R.; Hollis, G. F.; Schwarz, D. F.; Thomas, G. H.: Chromosomal translocation t(14;22) and oncogene (c-sis) variant in a pedigree with familial meningioma. New Eng. J. Med. 312: 564-567, 1985.

2382. Cohen, J. B.; Levinson, A. D.: A point mutation in the last intron responsible for increased expression and transforming activity of the c-Ha-ras oncogene. Nature 334: 119-124, 1988.

2383. Collins, T.; Ginsburg, D.; Boss, J. M.; Orkin, S. H.; Pober, J. S.: Cultured human endothelial cells express platelet-derived growth factor B chain: cDNA cloning and structural analysis. Nature 316:748-750, 1985.

2384. Dalla-Favera, R.; Gallo, R. C.; Giallongo, A.; Croce, C.: Chromosomal localization of the human homolog (c-sis) of the simian sarcoma virusonc gene. Science 218: 686-688, 1982.

2385. Dalla-Favera, R.; Gelmann, E. P.; Gallo, R. C.; Wong-Staal, F.: A human onc gene homologous to the transforming gene (v-sis) of simian sarcoma virus. Nature 292: 31-35, 1981.

2386. Deuel, T. F.; Huang, J. S.; Huang, S. S.; Stroobant, P.; Waterfield, M. D.: Expression of a platelet-derived growth factor-like protein in simian sarcoma virus transformed cells. Science 221: 1348-1350, 1983.

2387. Devare, S. G.; Reddy, E. P.; Law, J. D.; Robbins, K. C.; Aaronson, S. A.: Nucleotide sequence of the simian sarcoma virus genome: demonstration that its acquired cellular sequences encode the transforming gene product p28-sis. Proc. Nat. Acad. Sci. 80: 731-735, 1983.

2388. Benson, K. F.; Horwitz, M.; Wolff, J.; Friend, K.; Thompson, E.; White, S.; Richards, R. I.; Raskind, W. H.; Bird, T. D.: CAG repeat expansion in autosomal dominant familial spastic paraparesis: novel expansion in a subset of patients. Hum. Molec. Genet. 7: 1779-1786, 1998.

2389. Fonknechten, N.; Mavel, D.; Byrne, P.; Davoine, C.-S.; Cruaud, C.; Boentsch, D.; Samson, D.; Coutinho, P.; Hutchinson, M.; McMonagle, P.; Burgunder, J.-M.; Tartaglione, A.; and 10 others: Spectrum of SPG4 mutations in autosomal dominant spastic paraplegia. Hum. Molec. Genet. 9: 637-644, 2000.

2390. Nielsen, J. E.; Koefoed, P.; Abell, K.; Hasholt, L.; Eiberg, H.; Fenger, K.; Niebuhr, E.; Sorensen, S. A.: CAG repeat expansion in autosomal dominant pure spastic paraplegia linked to chromosome 2p21-p24. Hum. Molec. Genet. 6: 1811-1816, 1997.

2391. Svenson, I. K.; Ashley-Koch, A. E.; Gaskell, P. C.; Riney, T. J.; Cumming, W. J. K.; Kingston, H. M.; Hogan, E. L.; Boustany, R.-M. N.; Vance, J. M.; Nance, M. A.; Pericak-Vance, M. A.; Marchuk, D. A.: Identification and expression analysis of spastin gene mutations in hereditary spastic paraplegia. Am. J. Hum. Genet. 68: 1077-1085, 2001.

2392. Asch, A. S.; Barnwell, J.; Silverstein, R. L.; Nachman, R. L.: Isolation of the thrombospondin membrane receptor. J. Clin. Invest. 79:1054-1061, 1987.

2393. de Fraipont, F.; El Atifi, M.; Gicquel, C.; Bertagna, X.; Chambaz, E. M.; Feige, J. J.: Expression of the angiogenesis markers vascular endothelial growth factor-A, thrombospondin-1, and platelet-derived endothelial cell growth factor in human sporadic adrenocortical tumors: correlation with genotypic alterations. J. Clin. Endocr. Metab. 85:4734-4741, 2000.
2394. Dixit, V. M.; Hennessy, S. W.; Grant, G. A.; Rotwein, P.; Frazier, W. A.: Characterization of a cDNA encoding the heparin and collagen binding domains of human thrombospondin. Proc. Nat. Acad. Sci. 83:5449-5453, 1986.
2395. Frazier, W. A.: Thrombospondin: a modular adhesive glycoprotein of platelets and nucleated cells. J. Cell Biol. 105: 625-632, 1987.
2396. Jaffe, E.; Bornstein, P.; Disteche, C. M.: Mapping of the thrombospondin gene to human chromosome 15 and mouse chromosome 2 by in situ hybridization. Genomics 7:123-126, 1990.
2397. Lawler, J.; Sunday, M.; Thibert, V.; Duquette, M.; George, E. L.; Rayburn, H.; Hynes, R. O.: Thrombospondin-1 is required for normal murine pulmonary homeostasis and its absence causes pneumonia. J. Clin. Invest. 101: 982-992, 1998.
2398. Rodriguez-Manzaneque, J. C.; Lane, T. F.; Ortega, M. A.; Hynes, R. O.; Lawler, J.; Iruela-Arispe, M. L.: Thrombospondin-1 suppresses spontaneous tumor growth and inhibits activation of matrix metalloproteinase-9 and mobilization of vascular endothelial growth factor. Proc. Nat. Acad. Sci. 98: 12485-12490, 2001.
2399. Wolf, F. W.; Eddy, R. L.; Shows, T. B.; Dixit, V. M.: Structure and chromosomal localization of the human thrombospondin gene. Genomics 6:685-691, 1990.
2400. Peter, D.; Finn, J. P.; Klisak, I.; Liu, Y.; Kojis, T.; Heinzmann, C.; Roghani, A.; Sparkes, R. S.; Edwards, R. H.: Chromosomal localization of the human vesicular amine transporter genes. Genomics 18: 720-723, 1993.
2401. Roghani, A.; Welch, C.; Xia, Y.-R.; Liu, Y.; Peter, D.; Finn, J. P.; Edwards, R. H.; Lusis, A. J.: Assignment of the mouse vesicular monoamine transporter genes, Slc18a1 and Scl8a2, to chromosomes 8 and 19 by linkage analysis. Mammalian Genome 7: 393-394, 1996.
2402. Elchebly, M.; Payette, P.; Michaliszyn, E.; Cromlish, W.; Collins, S.; Loy, A. L.; Normandin, D.; Cheng, A.; Himms-Hagen, J.; Chan, C.-C.; Ramachandran, C.; Gresser, M. J.; Tremblay, M. L.; Kennedy, B. P.: Increased insulin sensitivity and obesity resistance in mice lackingthe protein tyrosine phosphatase-1B gene. Science 283: 1544-1548, 1999.
2403. Forsell, P. K. A. L.; Boie, Y.; Montalibet, J.; Collins, S.; Kennedy, B. P.: Genomic characterization of the human and mouse protein tyrosine phosphatase-1B genes. Gene 260: 145-153, 2000.
2404. Gu, H. F.; Almgren, P.; Lindholm, E.; Frittitta, L.; Pizzuti, A.; Trischitta, V.; Groop, L. C.: Association between the human glycoprotein PC-1 gene and elevated glucose and insulin levels in paired-sibling analysis. Diabetes 49: 1601-1603, 2000.
2405. Haj, F. G.; Verveer, P. J.; Squire, A.; Neel, B. G.; Bastiaens, P. I. H.: Imaging sites of receptor dephosphorylation by PTP1B on the surface of the endoplasmic reticulum. Science 295: 1708-1711, 2002.
2406. Jia, Z.; Barford, D.; Flint, A. J.; Tonks, N. K.: Structural basis for phosphotyrosine peptide recognition by protein tyrosine phosphatase 1B. Science 268: 1754-1758, 1995.
2407. Kennedy, B. P.; Ramachandran, C.: Protein tyrosine phosphatase-1B in diabetes. Biochem. Pharm. 60: 877-883, 2000.
2408. Mok, A.; Cao, H.; Zinman, B.; Hanley, A. J. G.; Harris, S. B.; Kennedy, B. P.; Hegele, R. A.: A single nucleotide polymorphism in protein tyrosine phosphatase PTP-1B is associated with protection from diabetes or impaired glucose tolerance in Oji-Cree. J. Clin. Endocr. Metab. 87: 724-727, 2002.
2409. Tonks, N. K.; Diltz, C. D.; Fischer, E. H.: Purification of the major protein-tyrosine-phosphatases of human placenta. J. Biol. Chem. 263:6722-6730, 1988.
2410. Chan, J. Y.; Cheung, M.-C.; Moi, P.; Chan, K.; Kan, Y. W.: Chromosomal localization of the human NF-E2 family of bZIP transcription factors by fluorescence in situ hybridization. Hum. Genet. 95: 265-269, 1995.
2411. Chan, J. Y.; Han, X.-L.; Kan, Y. W.: Cloning of Nrf1, an NF-E2-related transcription factor, by genetic selection in yeast. Proc. Nat. Acad. Sci. 90: 11371-11375, 1993.
2412. Chan, J. Y.; Kwong, M.; Lu, R.; Chang, J.; Wang, B.; Yen, T. S. B.; Kan, Y. W.: Targeted disruption of the ubiquitous CNC-bZIP transcription factor, Nrf-1, results in anemia and embryonic lethality in mice. EMBO J. 17: 1779-1787, 1998.
2413. Luna, L.; Johnsen, O.; Skartlien, A.; Pedeutour, F.; Turc-Carel, C.; Prydz, H.; Kolsto, A.-B.: Molecular cloning of a putative novel human bZIP transcription factor on chromosome 17q22. Genomics 22:553-562, 1994.
2414. Luna, L.; Johnsen, O.; Skartlien, A. H.; Pedeutour, F.; Turc-Carel, C.; Prydz, H.; Kolsto, A.-B.: Molecular cloning of a putative novel human bZIP transcription factor on chromosome 17q22. Genomics 22:553-562, 1994.
2415. McKie, J.; Johnstone, K.; Mattei, M.-G.; Scambler, P.: Cloning and mapping of murine Nfe2l1. Genomics 25: 716-719, 1995.
2416. McKie, J.; Scambler, P. J.: The Nfe2l1 gene maps to distal mouse chromosome 11. Mammalian Genome 7: 89-90, 1996.
2417. Liu, P.; Wakamiya, M.; Shea, M. J.; Albrecht, U.; Behringer, R. R.; Bradley, A.: Requirement for Wnt3 in vertebrate axis formation. Nature Genet. 22: 361-365, 1999.
2418. Rider, S. H.; Gorman, P. A.; Shipley, J.; Roeling, H.; Nusse, R.; Xu, W.; Sheer, D.; Solomon, E.: Localisation of the human int-4 (INT4) gene. (Abstract) Cytogenet. Cell Genet. 51: 1066 only, 1989.
2419. Roelink, H.; Wang, J.; Black, D. M.; Solomon, E.; Nusse, R.: Molecular cloning and chromosomal localization to 17q21 of the human WNT3 gene. Genomics 17:790-792, 1993.
2420. Lossie, A. C.; Gordon, D. F.; Camper, S. A.: Localization of thyrotropin-releasing hormone receptor and thyrotroph embryonic factor on mouse chromosome 15. Mammalian Genome 4: 621-623, 1993.
2421. Matre, V.; Karlsen, H. E.; Wright, M. S.; Lundell, I.; Fjeldheim, A. K.; Gabrielsen, O. S.; Larhammar, D.; Gautvik, K. M.: Molecular cloning of a functional human thyrotropin-releasing hormone receptor. Biochem. Biophys. Res. Commun. 195: 179-185, 1993.
2422. Morrison, N.; Duthie, S. M.; Boyd, E.; Eidne, K. A.; Connor, J. M.: Assignment of the gene encoding the human thyrotropin-releasing hormone receptor to 8q23 by fluorescence in situ hybridization. Hum. Genet. 93: 716-718, 1994.
2423. Straub, R. E.; Frech, G. C.; Joho, R. H.; Gershengorn, M. C.: Expression cloning of a cDNA encoding the mouse pituitary thyrotropin-releasing hormone receptor. Proc. Nat. Acad. Sci. 87: 9514-9518, 1990.
2424. Yamada, M.; Monden, T.; Konaka, S.; Mori, M.: Assignment of human thyrotropin-releasing hormone (TRH) receptor gene to chromosome 8. Somat. Cell Molec. Genet. 19: 577-580, 1993.

2425. Zhao, D.; Yang, J.; Jones, K. E.; Gerald, C.; Suzuki, Y.; Hogan, P. G.; Chin, W. W.; Tashjian, A. H., Jr.: Molecular cloning of a complementary deoxyribonucleic acid encoding the thyrotropin-releasing hormone receptor and regulation of its messenger ribonucleic acidin rat GH cells. Endocrinology 130: 3529-3536, 1992.

2426. Brennan, T. J.; Seeley, W. W.; Kilgard, M.; Schreiner, C. E.; Tecott, L. H.: Sound-induced seizures in serotonin 5-HT-2C receptor mutant mice. Nature Genet. 16: 387-390, 1997.

2427. Gurevich, I.; Tamir, H.; Arango, V.; Dwork, A. J.; Mann, J. J.; Schmauss, C.: Altered editing of serotonin 2C receptor pre-mRNA in the prefrontal cortex of depressed suicide victims. Neuron 34: 349-356, 2002.

2428. Hall, C. S.: Genetic differences in fatal audiogenic seizures: between two inbred strains of house mice. J. Hered. 38: 3-6, 1947.

2429. Lappalainen, J.; Zhang, L.; Dean, M.; Oz, M.; Ozaki, N.; Yu, D.; Virkkunen, M.; Weight, F.; Linnoila, M.; Goldman, D.: Identification, expression, and pharmacology of a cys(23)-ser(23) substitution in the human 5-HT(2C) receptor gene (HTR2C). Genomics 27: 274-279, 1995.

2430. Milatovich, A.; Hsieh, C.-L.; Bonaminio, G.; Tecott, L.; Julius, D.; Francke, U.: Serotonin receptor 1c gene assigned to X chromosomein human (band q24) and mouse (bands D-F4). Hum. Molec. Genet. 1:681-684, 1992.

2431. Tecott, L. H.; Sun, L. M.; Akana, S. F.; Strack, A. M.; Lowenstein, D. H.; Dallman, M. F.; Julius, D.: Eating disorder and epilepsy in mice lacking 5-HT2C serotonin receptors. Nature 374: 542-546, 1995.

2432. Prakash, S. K.; Paylor, R.; Jenna, S.; Lamarche-Vane, N.; Armstrong, D. L.; Xu, B.; Mancini, M. A.; Zoghbi, H. Y.: Functional analysis of ARHGAP6, a novel GTPase-activating protein for RhoA. Hum. Molec. Genet. 9: 477-488, 2000.

2433. Schaefer, L.; Prakash, S.; Zoghbi, H. Y.: Cloning and characterization of a novel rho-type GTPase-activating protein gene (ARHGAP6) from the critical region for microphthalmia with linear skin defects. Genomics 46:268-277, 1997.

2434. Aman, M. J.; Tayebi, N.; Obiri, N. I.; Puri, R. K.; Modi, W. S.; Leonard, W. J.: cDNA cloning and characterization of the human interleukin 13 receptor alpha chain. J. Biol. Chem. 271: 29265-29270, 1996.

2435. Guo, J.; Apiou, F.; Mellerin, M.-P.; Lebeau, B.; Jacques, Y.; Minvielle, S.: Chromosome mapping and expression of the human interleukin-13 receptor. Genomics 42: 141-5, 1997.

2436. Hilton, D. J.; Zhang, J.-G.; Metcalf, D.; Alexander, W. S.; Nicola, N. A.; Willson, T. A.: Cloning and characterization of a binding subunit of the interleukin 13 receptor that is also a component of the interleukin 4 receptor. Proc. Nat. Acad. Sci. 93: 497-501, 1996.

2437. Kleijnen, M. F.; Shih, A. H.; Zhou, P.; Kumar, S.; Soccio, R. E.; Kedersha, N. L.; Gill, G.; Howley, P. M.: The hPLIC proteins mayprovide a link between the ubiquitination machinery and the proteasome. Molec. Cell 6: 409-419, 2000.

2438. Riesewijk, A. M.; Blagitko, N.; Schinzel, A. A.; Hu, L.; Schulz, U.; Hamel, B. C. J.; Ropers, H.-H.; Kalscheuer, V. M.: Evidence against a major role of PEG1/MEST Silver-Russell syndrome. Europ. J. Hum. Genet. 6: 114-120, 1998.

2439. Riesewijk, A. M.; Hu, L.; Schulz, U.; Tariverdian, G.; Hoglund, P.; Kere, J.; Ropers, H.-H.; Kalscheuer, V. M.: Monoallelic expression of human PEG1/MEST is paralleled by parent-specific methylation infetuses. Genomics 42: 236-244, 1997.

2440. Sado, T.; Nakajima, N.; Tada, M.; Takagi, N.: A novel mesoderm-specific cDNA isolated from a mouse embryonal carcinoma cell line. Dev. Growth Differ. 35: 551-560, 1993.

2441. Jayakumar, A.; Chirala, S. S.; Chinault, A. C.; Baldini, A.; Abu-Elheiga, L.; Wakil, S. J.: Isolation and chromosomal mapping of genomic clones encoding the human fatty acid synthase gene. Genomics 23: 420-424, 1994.

2442. Jayakumar, A.; Tai, M.-H.; Huang, W.-Y.; Al-Feel, W.; Hsu, M.; Abu-Elheiga, L.; Chirala, S. S.; Wakil, S. J.: Human fatty acid synthase: properties and molecular cloning. Proc. Nat. Acad. Sci. 92: 8695-8699, 1995.

2443. Loftus, T. M.; Jaworsky, D. E.; Frehywot, G. L.; Townsend, C. A.; Ronnett, G. V.; Lane, M. D.; Kuhajda, F. P.: Reduced food intake and body weight in mice treated with fatty acid synthase inhibitors. Science 288:2379-2381, 2000.

2444. Wakil, S. J.: Fatty acid synthase, a proficient multifunctional enzyme. Biochemistry 28: 4523-4530, 1989.

2445. Ye, Q.; Chung, L. W. K.; Li, S.; Zhau, H. E.: Identification of a novel FAS/ER-alpha fusion transcript expressed in human cancer cells. Biochim. Biophys. Acta 1493: 373-377, 2000.

2446. Hansen, J. J.; Durr, A.; Cournu-Rebeix, I.; Georgopoulos, C.; Ang, D.; Nielsen, M. N.; Davoine, C.-S.; Brice, A.; Fontaine, B.; Gregersen, N.; Bross, P.: Hereditary spastic paraplegia SPG13 is associated with a mutation in the gene encoding the mitochondrial chaperonin Hsp60. Am. J. Hum. Genet. 70: 1328-1332, 2002.

2447. Todd, M. J.; Viitanen, P. V.; Lorimer, G. H.: Dynamics of the chaperonin ATPase cycle: implications for facilitated protein folding. Science 265:659-666, 1994.

2448. Di Paola, R.; Frittitta, L.; Miscio, G.; Bozzali, M.; Baratta, R.; Centra, M.; Spampinato, D.; Santagati, M. G.; Ercolino, T.; Cisternino, C.; Soccio, T. Mastroianno, S.; Tassi, V.; Almgren, P.; Pizzuti, A.; Vigneri, R.; Trischitta, V.: A variation in 3-prime UTR of hPTP1B increases specific gene expression and associates with insulin resistance. Am. J. Hum. Genet. 70: 806-812, 2002.

2449. Eidne, K.; Taylor, P.; Connor, M.; Duthie, S.: Isolation, characterization and chromosomal localization of the human thyrotropin releasing hormone receptor. (Abstract) 75th Annual Meeting of the Endocr. Soc. 437 only, 1993.

2450. Gedde-Dahl, T., Jr.; Olaisen, B.; Teisberg, P.; Wilhelmy, M. C.; Mevag, B.; Helland, R.: The locus for apolipoprotein E (apoE) is close to the Lutheran (Lu) blood group locus on chromosome 19. Hum. Genet. 67: 178-182, 1984.

2451. Ogasawara, M.; Kim, S.-C.; Adamik, R.; Togawa, A.; Ferrans, V. J.; Takeda, K.; Kirby, M.; Moss, J.; Vaughan, M.: Similarities in function and gene structure of cytohesin-4 and cytohesin-1, guanine nucleotide-exchange proteins for ADP-ribosylation factors. J. Biol. Chem. 275: 3221-3230, 2000.

2452. Helwig, U.; Imai, K.; Schmahl, W.; Thomas, B. E.; Varnum, D. S.; Nadeau, J. H.; Balling, R.: Interaction between undulated and Patchleads to an extreme form of spina bifida in double-mutant mice. Nature Genet. 11: 60-63, 1995.

2453. Barnett, T.; Pickle, W., II; Rae, P. M. M.; Hart, J.; Kamarck, M.; Elting, J.: Pregnancy-specific beta-1-glycoproteins are related to carcinoembryonic antigens and map to chromosome 19. (Abstract) Cytogenet. Cell Genet. 51: 958, 1989.

2454. Barnett, T. R.; Pickle, W., II; Rae, P. M. M.; Hart, J.; Kamarck, M.; Elting, J.: Human pregnancy-specific beta (1)-glycoproteins are coded within chromosome 19. Am. J. Hum. Genet. 44: 890-893, 1989.

2455. Bartels, I.; Lindemann, A.: Maternal levels of pregnancy-specificbeta-1-glycoprotein (SP-1) are elevated in pregnancies affected by Down's syndrome. Hum. Genet. 80: 46-48, 1988.

2456. Brandriff, B. F.; Gordon, L. A.; Tynan, K. T.; Olsen, A. S.; Mohrenweiser, H. W.; Fertitta, A.; Carrano, A. V.; Trask, B. J.: Order and genomic distances among members of the carcinoembryonic antigen (CEA) gene family determined by fluorescence in situ hybridization. Genomics 12:773-779, 1992.

2457. Chan, W.-Y.; Qiu, W.-R.: Human pregnancy-specific beta-1 glycoproteinis encoded by multiple genes localized on two chromosomes. Am. J. Hum. Genet. 43: 152-159, 1988.

2458. Khan, W. N.; Teglund, S.; Bremer, K.; Hammarstrom, S.: The pregnancy-specific glycoprotein family of the immunoglobulin superfamily: identification of new members and estimation of family size. Genomics 12: 780-787, 1992.

2459. Niemann, S. C.; Flake, A.; Bohn, H.; Bartels, I.: Pregnancy-specificbeta-1-glycoprotein: cDNA cloning, tissue expression, and species specificity of one member of the PSBG family. Hum. Genet. 82: 239-243, 1989.

2460. Niemann, S. C.; Schonk, D.; van Dijk, P.; Wieringa, B.; Grzeschik, K.-H.; Bartels, I.: Regional localization of the gene encoding pregnancy specific beta-1-glycoprotein 1 (PSBG1) to human chromosome 19q13.1. Cytogenet. Cell Genet. 52: 95-97, 1989.

2461. Niemann, S. C.; Schonk, D.; van Dijk, P. E.; Grzeschik, K.-H.; Bartels, I.: Chromosomal assignment of a cDNA clone encoding pregnancy-specific beta-1-glycoprotein to chromosome 19. (Abstract) Cytogenet. Cell Genet. 51: 1053, 1989.

2462. Olsen, A.; Teglund, S.; Nelson, D.; Gordon, L.; Copeland, A.; Georgescu, A.; Carrano, A.; Hammarstrom, S.: Gene organization of the pregnancy-specific glycoprotein region on human chromosome 19: assembly and analysis of a 700-kb cosmid contig spanning the region. Genomics 23:659-668, 1994.

2463. Streydio, C.; Swillens, S.; Georges, M.; Szpirer, C.; Vassart, G.: Structure, evolution and chromosomal localization of the human pregnancy-specific beta-1 glycoprotein gene family. Genomics 6:579-592, 1990. Note: Erratum: Genomics 7: 661-662, 1990.

2464. Teglund, S.; Olsen, A.; Khan, W. N.; Frangsmyr, L.; Hammarstrom, S.: The pregnancy-specific glycoprotein (PSG) gene cluster on human chromosome 19: fine structure of the 11 PSG genes and identification of 6 new genes forming a third subgroup within the carcinoembryonicantigen (CEA) family. Genomics 23: 669-684, 1994.

2465. Thompson, J.; Koumari, R.; Wagner, K.; Barnert, S.; Schleussner, C.; Schrewe, H.; Zimmermann, W.; Muller, G.; Schempp, W.; Zaninetta, D.; Ammaturo, D.; Hardman, N.: The human pregnancy-specific glycoproteingenes are tightly linked on the long arm of chromosome 19 and are-coordinately expressed. Biochem. Biophys. Res. Commun. 167: 848-859, 1990.

2466. Watanabe, S.; Chou, J. Y.: Isolation and characterization of complementary DNAs encoding human pregnancy-specific beta-1-glycoprotein. J. Biol. Chem. 263: 2049-2054, 1988.

2467. Olsen, A.; Teglund, S.; Nelson, D.; Gordon, L.; Copeland, A.; Georgescu, A.; Carrano, A.; Hammarstrom, S.: Gene organization of the pregnancy-specific glycoprotein region on human chromosome 19: assembly and analysis of a 700-kb cosmid contig spanning the region. Genomics 23: 659-668, 1994.

2468. Thompson, J.; Zimmermann, W.; Osthus-Bugat, P.; Schleussner, C.; Eades-Perner, A.-M.; Barnert, S.; von Kleist, S.; Willcocks, T.; Craig, I.; Tynan, K.; Olsen, A.; Mohrenweiser, H.: Long-range chromosomal mapping of the carcinoembryonic antigen (CEA) gene family cluster. Genomics 12:761-772, 1992.

2469. Tynan, K.; Olsen, A.; Trask, B.; de Jong, P.; Thompson, J.; Zimmermann, W.; Carrano, A.; Mohrenweiser, H.: Assembly and analysis of cosmid contigs in the CEA-gene family region of human chromosome 19. Nucleic Acids Res. 20: 1629-1636, 1992.

2470. Nobukuni, Y.; Watanabe, A.; Takeda, K.; Skarka, H.; Tachibana, M.: Analyses of loss-of-function mutations of the MITF gene suggest that haploin sufficiency is a cause of Waardenburg syndrome type 2A. Am. J. Hum. Genet. 59: 76-83, 1996.

2471. Steingrimsson, E.; Moore, K. J.; Lamoreux, M. L.; Ferre-D'Amare, A. R.; Burley, S. K.; Sanders Zimring, D. C.; Skow, L. C.; Hodgkinson, C. A.; Arnheiter, H.; Copeland, N. G.; Jenkins, N. A.: Molecular basis of mouse microphthalmia (mi) mutations helps explain their developmental and phenotypic consequences. Nature Genet. 8: 256-263, 1994.

2472. Steingrimsson, E.; Tessarollo, L.; Pathak, B.; Hou, L.; Arnheiter, H.; Copeland, N. G.; Jenkins, N. A.: Mitf and Tfe3, two members of the Mitf-Tfe family of bHLH-Zip transcription factors, have important but functionally redundant roles in osteoclast development. Proc. Nat. Acad. Sci. 99: 4477-4482, 2002.

2473. Tachibana, M.; Perez-Jurado, L. A.; Nakayama, A.; Hodgkinson, C. A.; Li, X.; Schneider, M.; Miki, T.; Fex, J.; Francke, U.; Arnheiter, H.: Cloning of MITF, the human homolog of the mouse microphthalmia gene and assignment to chromosome 3p14.1-p12.3. Hum. Molec. Genet. 3:553-557, 1994.

2474. Tachibana, M.; Takeda, K.; Nobukuni, Y.; Urabe, K.; Long, J. E.; Meyers, K. A.; Aaronson, S. A.; Miki, T.: Ectopic expression of MITF, a gene for Waardenburg syndrome type 2, converts fibroblasts to cells with melanocytes characteristics. Nature Genet. 14: 50-54, 1996.

2475. Takeda, K.; Takemoto, C.; Kobayashi, I.; Watanabe, A.; Nobukuni, Y.; Fisher, D. E.; Tachibana, M.: Ser298 of MITF, a mutation sitein Waardenburg syndrome type 2, is a phosphorylation site with functional significance. Hum. Molec. Genet. 9: 125-132, 2000.

2476. Tassabehji, M.; Newton, V. E.; Read, A. P.: Waardenburg syndrometype 2 caused by mutations in the human microphthalmia (MITF) gene. Nature Genet. 8: 251-255, 1994.

2477. Watanabe, A.; Takeda, K.; Ploplis, B.; Tachibana, M.: Epistatic relationship between Waardenburg syndrome genes MITF and PAX3. Nature Genet. 18: 283-286, 1998.

2478. Yoshitake, H.; Rittling, S. R.; Denhardt, D. T.; Noda, M.: Osteopontin-deficient mice are resistant to ovariectomy-induced bone resorption. Proc. Nat. Acad. Sci. 96: 8156-8160, 1999.

2479. St-Onge, L.; Sosa-Pineda, B.; Chowdhury, K.; Mansouri, A.; Gruss, P.: Pax6 is required for differentiation of glucagon-producing alpha-cells in mouse pancreas. Nature 387: 406-409, 1997.

2480. Bongarzone, I.; Vigano, E.; Alberti, L.; Borrello, M. G.; Pasini, B.; Greco, A.; Mondellini, P.; Smith, D. P.; Ponder, B. A. J.; Romeo, G.; Pierotti, M. A.: Full activation of MEN2B mutant RET by an additional MEN2A mutation or by ligand GDNF stimulation. Oncogene 16: 2295-2301, 1998.

2481. Carlson, K. M.; Bracamontes, J.; Jackson, C. E.; Clark, R.; Lacroix, A.; Wells, S. A., Jr.; Goodfellow, P. J.: Parent-of-origin effects in multiple endocrine neoplasia type 2B. Am. J. Hum. Genet. 55:1076-1082, 1994.

2482. Carlson, K. M.; Dou, S.; Chi, D.; Scavarda, N.; Toshima, K.; Jackson, C. E.; Wells, S. A., Jr.; Goodfellow, P. J.; Donis-Keller, H.: Single missense mutation in the tyrosine kinase catalytic domain of the RET protooncogene is associated with multiple endocrine neoplasia type 2B. Proc. Nat. Acad. Sci. 91: 1579-1583, 1994.

2483. Mulligan, L. M.; Eng, C.; Healey, C. S.; Clayton, D.; Kwok, J. B. J.; Gardner, E.; Ponder, M. A.; Frilling, A.; Jackson, C. E.; Lehnert, H.; Neumann, H. P. H.; Thibodeau, S. N.; Ponder, B. A. J.: Specific mutations of the RET protooncogene are related to disease phenotype in MEN 2A and FMTC. Nature Genet. 6: 70-74, 1994.

2484. Disteche, C. M.; Brannan, C. I.; Larsen, A.; Adler, D. A.; Schorderet, D. F.; Gearing, D.; Copeland, N. G.; Jenkins, N. A.; Park, L. S.: The human pseudo autosomal GM-CSF receptor alpha subunit gene is autosomal in mouse. Nature Genet. 1: 333-336, 1992.

2485. Fujii, J.; Zarain-Herzberg, A.; Willard, H. F.; Tada, M.; MacLennan, D. H.: Structure of the rabbit phospholamban gene, cloning of the human cDNA, and assignment of the gene to human chromosome 6. J. Biol. Chem. 266: 11669-11675, 1991.

2486. McTiernan, C. F.; Frye, C. S.; Lemster, B. H.; Kinder, E. A.; Ogletree-Hughes, M. L.; Moravec, C. S.; Feldman, A. M.: The human phospholamban gene: structure and expression. J. Molec. Cell Cardiol. 31: 679-692, 1999.

2487. Otsu, K.; Fujii, J.; Periasamy, M.; Difilippantonio, M.; Uppender, M.; Ward, D. C.; MacLennan, D. H.: Chromosome mapping of five human cardiac and skeletal muscle sarcoplasmic reticulum protein genes. Genomics 17:507-509, 1993.

2488. Coleman, R. A.; Smith, W. L.; Narumiya, S.: Vil. International union of pharmacology classification of prostanoid receptors: properties, distribution, and structure of the receptors and their subtypes. Pharm. Rev. 46: 205-229, 1994.

2489. Duncan, A. M. V.; Anderson, L. L.; Funk, C. D.; Abramovitz, M.; Adam, M.: Chromosomal localization of the human prostanoid receptor gene family. Genomics 25: 740-742, 1995.

2490. Taketo, M.; Rochelle, J. M.; Sugimoto, Y.; Namba, T.; Honda, A.; Negishi, M.; Ichikawa, A.; Narumiya, S.; Seldin, M. F.: Mapping of the genes encoding mouse thromboxane A2 receptor and prostaglandin E receptor subtypes EP2 and EP3. Genomics 19: 585-588, 1994.

2491. Shimomura, I.; Matsuda, M.; Hammer, R. E.; Bashmakov, Y.; Brown, M. S.; Goldstein, J. L.: Decreased IRS-2 and increased SREBP-1c lead to mixed insulin resistance and sensitivity in livers of lipodystrophic and ob/ob mice. Molec. Cell 6: 77-86, 2000.

2492. Muyan, M.; Furuhashi, M.; Sugahara, T.; Boime, I.: The carboxy-terminal region of the beta-subunits of luteinizing hormone and chorionic gonadotropin differentially influence secretion and assembly of the heterodimers. Molec. Endocr. 10: 1678-1687, 1996.

2493. Adam, M.; Boie, Y.; Rushmore, T. H.; Muller, G.; Bastien, L.; McKee, K. T.; Metters, K. M.; Abramovitz, M.: Cloning and expression of three isoforms of the human EP(3) prostanoid receptor. FEBS Lett. 338:170-174, 1994.

2494. Kotani, M.; Tanaka, I.; Ogawa, Y.; Suganami, T.; Matsumoto, T.; Muro, S.; Yamamoto, Y.; Sugawara, A.; Yoshimasa, Y.; Sagawa, N.; Narumiya, S.; Nakao, K.: Multiple signal transduction pathways through two prostaglandin E receptor EP3 subtype isoforms expressed in human uterus. J. Clin. Endocr. Metab. 85: 4315-4322, 2000.

2495. Kotani, M.; Tanaka, I.; Ogawa, Y.; Usui, T.; Mori, K.; Ichikawa, A.; Narumiya, S.; Yoshimi, T.; Nakao, K.: Molecular cloning and expression of multiple isoforms of human prostaglandin E receptor EP(3) subtype generated by alternative messenger RNA splicing: multiple second messenger systems and tissue-specific distributions. Molec. Pharm. 48: 869-879, 1995.

2496. Kotani, M.; Tanaka, I.; Ogawa, Y.; Usui, T.; Tamura, N.; Mori, K.; Narumiya, S.; Yoshimi, T.; Nakao, K.: Structural organization of the human prostaglandin EP(3) receptor subtype gene (PTGER3). Genomics 40:425-434, 1997.

2497. Schmid, A.; Thierauch, K.-H.; Schleuning, W.-D.; Dinter, H.: Splice variants of the human EP(3) receptor for prostaglandin E(2). Europ. J. Biochem. 228: 23-30, 1995.

2498. Ushikubi, F.; Segi, E.; Sugimoto, Y.; Murata, T.; Matsuoka, T.; Kobayashi, T.; Hizaki, H.; Tuboi, K.; Katsuyama, M.; Ichikawa, A.; Tanaka, T.; Yoshida, N.; Narumiya, S.: Impaired febrile response in mice lacking the prostaglandin E receptor subtype EP(3). Nature 395:281-284, 1998.

2499. Kaplan, R.; Morse, B.; Huebner, K.; Croce, C.; Howk, R.; Ravera, M.; Ricca, G.; Jaye, M.; Schlessinger, J.: Cloning of three human tyrosine phosphatases reveals a multigene family of receptor-linked protein-tyrosine-phosphatases expressed in brain. Proc. Nat. Acad. Sci. 87: 7000-7004, 1990.

2500. Jirik, F. R.; Anderson, L. L.; Duncan, A. M. V.: The human protein-tyrosine phosphatase PTP-alpha/LRP gene (PTPA) is assigned to chromosome 20p13. Cytogenet. Cell Genet. 60: 117-118, 1992.

2501. Jirik, F. R.; Janzen, N. M.; Melhado, I. G.; Harder, K. W.: Cloning and chromosomal assignment of a widely expressed human receptor-like protein-tyrosine phosphatase. FEBS Lett. 273: 239-242, 1990.

2502. Matthews, R. J.; Cahir, E. D.; Thomas, M. L.: Identification of an additional member of the protein-tyrosine-phosphatase family: evidence for alternative splicing in the tyrosine phosphatase domain. Proc. Nat. Acad. Sci. 87: 4444-4448, 1990.

2503. Rao, V. V. N. G.; Loffler, C.; Sap, J.; Schlessinger, J.; Hansmann, I.: The gene for receptor-linked protein-tyrosine-phosphatase (PTPA) is assigned to human chromosome 20p12-pter by in situ hybridization (ISH and FISH). Genomics 13: 906-907, 1992.

2504. Schnittger, S.; Rao, V. V. N. G.; Deutsch, U.; Gruss, P.; Balling, R.; Hansmann, I.: PAX1, a member of the paired box-containing class of developmental control genes, is mapped to human chromosome 20p11.2 by in situ hybridization (ISH and FISH). Genomics 14: 740-744, 1992.

2505. Ahmad, F.; Azevedo, J. L., Jr.; Cortright, R.; Dohm, G. L.; Goldstein, B. J.: Alternations in skeletal muscle protein-tyrosine phosphatase activity and expression in insulin-resistant human obesity and diabetes. J. Clin. Invest. 100: 449-458, 1997.

2506. Brown-Shimer, S.; Johnson, K. A.; Lawrence, J. B.; Johnson, C.; Bruskin, A.; Green, N. R.; Hill, D. E.: Molecular cloning and chromosome mapping of the human gene encoding protein phosphotyrosyl phosphatase 1B. Proc. Nat. Acad. Sci. 87: 5148-5152, 1990.

2507. Charbonneau, H.; Tonks, N. K.; Kumar, S.; Diltz, C. D.; Harrylock, M.; Cool, D. E.; Krebs, E. G.; Fischer, E. H.;

Walsh, K. A.: Human placenta protein-tyrosine-phosphatase: amino acid sequence and relationship to a family of receptor-like proteins. Proc. Nat. Acad. Sci. 86:5252-5256, 1989.

2508. Chernoff, J.; Schievella, A. R.; Jost, C. A.; Erikson, R. L.; Neel, B. G.: Cloning of a cDNA for a major human protein-tyrosine-phosphatase. Proc. Nat. Acad. Sci. 87: 2735-2739, 1990.

2509. Mastick, C. C.; Brady, M. J.; Saltiel, A. R.: Insulin stimulates the tyrosine phosphorylation of caveolin. J. Cell Biol. 129: 1523-1531, 1995. Nager syndrome. Mammalian Genome 11:1000-1005, 2000.

2521. Riazuddin, S.; Castelein, C. M.; Ahmed, Z. M.; Lalwani, A. K.; Mastroianni, M. A.; Naz, S.; Smith, T. N.; Liburd, N. A.; Friedman, T. B.; Griffith, A. J.; Riazuddin, S.; Wilcox, E. R.: Dominant modifier DFNM1 suppresses recessive deafness DFNB26. Nature Genet. 26: 431-434, 2000.

2522. Coleman, M. P.; Ambrose, H. J.; Carrel, L.; Nemeth, A. H.; Willard, H. F.; Davies, K. E.: A novel gene, DXS8237E, lies within 20 kb upstream of UBEL in Xp11.23 and has a different X inactivation status. Genomics 31:135-138, 1996.

2523. Inoue, A.; Takahashi, K. P.; Kimura, M.; Watanabe, T.; Morisawa, S.: Molecular cloning of a RNA binding protein, S1-1. Nucleic Acids Res. 24: 2990-2997, 1996.

2524. Nagase, T.; Seki, N.; Tanaka, A.; Ishikawa, K.; Nomura, N.: Prediction of the coding sequences of unidentified human genes. IV. The coding sequences of 40 new genes (KIAA0121-KIAA0160) deduced by analysis of cDNA clones from human cell line KG-1. DNA Res. 2: 167-174, 1995.

2525. Lin, C.-S.; Aebersold, R. H.; Leavitt, J.: Correction of the N-terminal sequences of the human plastin isoforms 2510. Soubeyran, P.; Kowanetz, K.; Szymkiewicz, I.; Langdon, W. Y.; Dikic, I.: Cbl-CIN85-endophilin complex mediates ligand-induced down regulation of EGF receptors. Nature 416: 183-187, 2002.

2511. Nakamura, M.; Nagano, T.; Chikama, T.; Nishida, T.: Role of the small GTP-binding protein Rho in epithelial cell migration in the rabbit cornea. Invest. Ophthal. Vis. Sci. 42: 941-947, 2001.

2512. Rao, P. V.; Deng, P.-F.; Kumar, J.; Epstein, D. L.: Modulation of aqueous humor outflow facility by the Rho kinase-specific inhibitor Y-27632. Invest. Ophthal. Vis. Sci. 42: 1029-1037, 2001.

2513. Gharib, B.; Fox, M. F.; Bartoli, C.; Giorgi, D.; Sansonetti, A.; Swallow, D. M.; Dagorn, J. C.; Berge-Lefranc, J. L.: Human regeneration protein/lithostathine genes map to chromosome 2p12. Ann. Hum. Genet. 57:9-16, 1993.

2514. Miyashita, H.; Nakagawara, K.; Mori, M.; Narushima, Y.; Noguchi, N.; Moriizumi, S.; Takasawa, S.; Yonekura, H.; Takeuchi, T.; Okamoto, H.: Human REG family genes are tandemly ordered in a 95-kilobase region of chromosome 2p12. FEBS Lett. 377: 429-433, 1995.

2515. Moriizumi, S.; Watanabe, T.; Unno, M.; Nakagawara, K.; Suzuki, Y.; Miyashita, H.; Yonekura, H.; Okamoto, H.: Isolation, structural determination and expression of a novel reg gene, human reg1-beta. Biochim. Biophys. Acta 1217: 199-202, 1994.

2516. Holmes, C.; Arranz, M. J.; Powell, J. F.; Collier, D. A.; Lovestone, S.: 5-HT-2A and 5-HT-2C receptor polymorphisms and psychopathology in late onset Alzheimer's disease. Hum. Molec. Genet. 7: 1507-1509, 1998.

2517. Grueneberg, D. A.; Natesan, S.; Alexandre, C.; Gilman, M. Z.: Human and *Drosophila* homeodomain proteins that enhance the DNA-binding activity of serum response factor. Science 257: 1089-1095, 1992.

2518. Kern, M. J.; Argao, E. A.; Birkenmeier, E. H.; Rowe, L. B.; Potter, S. S.: Genomic organization and chromosome localization of the murine homeobox gene Pmx. Genomics 19: 334-340, 1994.

2519. Nakamura, T.; Yamazaki, Y.; Hatano, Y.; Miura, I.: NUP98 is fused to PMX1 homeobox gene in human acute myelogenous leukemia with chromosome translocation t(1;11)(q23;p15). Blood 94: 741-747, 1999.

2520. Norris, R. A.; Scott, K. K.; Moore, C. S.; Stetten, G.; Brown, C. R.; Jabs, E. W.; Wulfsberg, E. A.; Yu, J.; Kern, M. J.: Human PRRX1 and PRRX2 genes: cloning, expression, genomic localization, and exclusion as disease genes for by using anchored polymerase chain reaction: identification of a potential calcium-binding domain. Molec. Cell. Biol. 10: 1818-1821, 1990.

2526. Lahn, B. T.; Page, D. C.: Functional coherence of the human Y chromosome. Science 278: 675-680, 1997.

2527. Barletta, C.; Druck, T.; LaForgia, S.; Calabretta, B.; Drabkin, H.; Patterson, D.; Croce, C. M.; Huebner, K.: Chromosome locations of the MYB related genes, AMYB and BMYB. Cancer Res. 51: 3821-3824, 1991.

2528. Nomura, N.; Takahashi, M.; Matsui, M.; Ishii, S.; Date, T.; Sasamoto, S.; Ishizaki, R.: Isolation of human cDNA clones of MYB-related genes, A-MYB and B-MYB. Nucleic Acids Res. 16: 11075-11089, 1988.

2529. Takahashi, T.; Nakagoshi, H.; Sarai, A.; Nomura, N.; Yamamoto, T.; Ishii, S.: Human A-myb gene encodes a transcriptional activator containing the negative regulatory domains. FEBS Lett. 358: 89-96, 1995.

2530. Ellis, N. A.: Ecce Ohno. Nature Genet. 10: 373-375, 1995.

2531. Haldane, J. B. S.: Sex ratio and unisexual sterility in hybrid animals. J. Genet. 12: 101-109, 1922.

2532. Milatovich, A.; Kitamura, T.; Miyajima, A.; Francke, U.: Gene for the alpha-subunit of the human interleukin-3 receptor (IL3RA) localized to the X-Y pseudo autosomal region. Am. J. Hum. Genet. 53:1146-1153, 1993.

2533. Ohno, S.: Sex Chromosomes and Sex-linked Genes. Berlin and New York: Springer (pub.) 1967.

2534. Palmer, S.; Perry, J.; Ashworth, A.: A contravention of Ohno's law in mice. Nature Genet. 10: 472-476, 1995.

2535. Rugarli, E. I.; Adler, D. A.; Borsani, G.; Tsuchiya, K.; Franco, B.; Hauge, X.; Disteche, C.; Chapman, V.; Ballabio, A.: Different chromosomal localization of the Clcn4 gene in Mus spretus and C57BL/6j mice. Nature Genet. 10: 466-471, 1995.

2536. Schnur, R. E.; Wick, P. A.: Intragenic TaqI restriction fragment length polymorphism (RFLP) in CLCN4, between the loci for X-linked ocular albinism (OA1) and microphthalmia with linear skin defects syndrome (MLS). Hum. Genet. 95: 594-595, 1995.

2537. van Slegtenhorst, M. A.; Bassi, M. T.; Borsani, G.; Wapenaar, M. C.; Ferrero, G. B.; de Conciliis, L.; Rugarli, E. I.; Grillo, A.; Franco, B.; Zoghbi, H. Y.; Ballabio, A.: A gene from the Xp22.3 region shares homology with voltage-gated chloride channels. Hum. Molec. Genet. 3: 547-552, 1994.

2538. Grandori, C.; Mac, J.; Siebelt, F.; Ayer, D. E.; Eisenman, R. N.: Myc-Max heterodimers activate a DEAD box gene and interact with multiple E box-related sites in vivo. EMBO J. 15: 4344-4357, 1996.

2539. Prendergast, G. C.; Lawe, D.; Ziff, E. B.: Association of Myn, the murine homolog of Max, with c-Myc stimulates methylation-sensitive DNA binding and Ras cotransformation. Cell 65: 395-408, 1991.

2540. Wagner, A. J.; Le Beau, M. M.; Diaz, M. O.; Hay, N.: Expression, regulation, and chromosomal localization of the Max gene. Proc. Nat. Acad. Sci. 89: 3111-3115, 1992.

2541. Zervos, A. S.; Faccio, L.; Gatto, J. P.; Kyriakis, J. M.; Brent, R.: Mxi2, a mitogen-activated protein kinase that recognizes and phosphorylates Max protein. Proc. Nat. Acad. Sci. 92: 10531-10534, 1995.

2542. Bonner, T. I.; Young, A. C.; de Miguel, C.; Detera-Wadleigh, S.; Modi, W. S.; O'Brien, S. J.: The chromosomal location of the two human tackykinin (sic) genes: human substance P and neurokinin K. (Abstract) Cytogenet. Cell Genet. 46: 584 only, 1987.

2543. Cao, Y. Q.; Mantyh, P. W.; Carlson, E. J.; Gillespie, A.-M.; Epstein, C. J.; Basbaum, A. I.: Primary afferent tachykinins are required to experience moderate to intense pain. Nature 392: 390-393, 1998.

2544. Krause, J. E.; Chirgwin, J. M.; Carter, M. S.; Xu, Z. S.; Hershey, A. D.: Three rat preprotachykinin mRNAs encode the neuropeptides substance P and neurokinin A. Proc. Nat. Acad. Sci. 84: 881-885, 1987.

2545. Liu, H.; Cao, Y.; Basbaum, A. I.; Mazarati, A. M; Sankar, R.; Wasterlain, C. G.: Resistance to excitotoxin-induced seizures and neuronal death in mice lacking the preprotachykinin A gene. Proc. Nat. Acad. Sci. 96:12096-12101, 1999.

2546. Troger, J.; Neyer, S.; Heufler, C.; Huemer, H.; Schmid, E.; Griesser, U.; Kralinger, M.; Kremser, B.; Baldissera, I.; Kieselbach, G.: Substance P and vasoactive intestinal polypeptide in the streptozotocin-induced diabetic rat retina. Invest. Ophthal. Vis. Sci. 42: 1045-1050, 2001.

2547. Zimmer, A.; Zimmer, A. M.; Baffi, J.; Usdin, T.; Reynolds, K.; Konig, M.; Palkovits, M.; Mezey, E.: Hypoalgesia in mice with a targeted deletion of the tachykinin 1 gene. Proc. Nat. Acad. Sci. 95: 2630-2635, 1998.

2548. Mattei, M.-G.; Riviere, M.; Krust, A.; Ingvarsson, S.; Vennstrom, B.; Islam, M. Q.; Levan, G.; Kautner, P.; Zelent, A.; Chambon, P.; Szpirer, J.; Szpirer, C.: Chromosomal assignment of retinoic acid receptor (RAR) genes in the human, mouse, and rat genomes. Genomics 10:1061-1069, 1991.

2549. Abramson, D. H.; Ellsworth, R. M.; Zimmerman, L. E.: Monocular cancer in retinoblastoma survivors. Trans. Am. Acad. Ophthal. Otolaryng. 81:454-457, 1976.

2550. Aherne, G. E. S.; Roberts, D. F.: Retinoblastoma—a clinical survey and its genetic implications. Clin. Genet. 8: 275-290, 1975.

2551. Alonso, J.; Garcia-Miguel, P.; Abelairas, J.; Mendiola, M.; Sarret, E.; Vendrell, M. T.; Navajas, A.; Pestana, A.: Spectrum of germline RB1 gene mutations in Spanish retinoblastoma patients: phenotypic and molecular epidemiological implications. Hum. Mutat. 17: 412-422, 2001.

2552. Amoaku, W. M. K.; Willshaw, H. E.; Parkes, S. E.; Shah, K. J.; Mann, J. R.: Trilateral retinoblastoma: a report of five patients. Cancer 78:858-863, 1996.

2553. Bader, J. L.; Meadows, A. T.; Zimmerman, L. E.; Rorke, L. B.; Voute, P. A.; Champion, L. A. A.; Miller, R. W.: Bilateral retinoblastoma with ectopic intracranial retinoblastoma: trilateral retinoblastoma. Cancer Genet. Cytogenet. 5: 203-213, 1982.

2554. Balaban-Malenbaum, G.; Gilbert, F.; Nichols, W. W.; Hill, R.; Shields, J.; Meadows, A. T.: A deleted chromosome no. 13 in human retinoblastoma cells: relevance to tumorigenesis. Cancer Genet. Cytogenet. 3: 243-250, 1981.

2555. Bandara, L. R.; Adamczewski, J. P.; Hunt, T.; La Thangue, N. B.: Cyclin A and the retinoblastoma gene product complex with a common transcription factor. Nature 352: 249-251, 1991.

2556. Benedict, W. F.; Murphree, A. L.; Banerjee, A.; Spina, C. A.; Sparkes, M. C.; Sparkes, R. S.: Patient with 13 chromosome deletion: evidence that the retinoblastoma gene is a recessive cancer gene. Science 219:973-975, 1983.

2557. Benedict, W. F.; Xu, H.-J.; Hu, S.-X.; Takahashi, R.: Role of the retinoblastoma gene in the initiation and progression of human cancer. J. Clin. Invest. 85: 988-993, 1990.

2558. Bia, B.; Cowell, J. K.: Independent constitutional germline mutations occurring in the RB1 gene in cousins with bilateral retinoblastoma. Oncogene 11:977-979, 1995.

2559. Blanquet, V.; Turleau, C.; de Grouchy, J.; Creau-Goldberg, N.: Physical map around the retinoblastoma gene: possible genomic imprinting suggested by NruI digestion. Genomics 10: 350-355, 1991.

2560. Blanquet, V.; Turleau, C.; Gross-Morand, M. S.; Senamaud-Beaufort, C.; Doz, F.; Besmond, C.: Spectrum of germline mutations in the RB1 gene: a study of 232 patients with hereditary and non hereditary retinoblastoma. Hum. Molec. Genet. 4: 383-388, 1995.

2561. Nicklin, M. J. H.; Weith, A.; Duff, G. W.: A physical map of the region encompassing the human interleukin-1-alpha, interleukin-1-beta, and interleukin-1 receptor antagonist genes. Genomics 19: 382-384, 1994.

2562. Ansano, M.; Toda, M.; Sakaguchi, N.; Sakaguchi, S.: Autoimmune disease as a consequence of developmental abnormality of a T cell subpopulation. J. Exp. Med. 184: 387-396, 1996.

2563. Cosman, D.; Cerretti, D. P.; Larsen, A.; Park, L.; March, C.; Dower, S.; Gillis, S.; Urdal, D.: Cloning, sequence and expression of human interleukin-2 receptor. Nature 312: 768-771, 1984.

2564. Ferrari, S.; Cannizzaro, L. A.; Battini, R.; Huebner, K.; Baserga, R.: The gene encoding human vimentin is located on the short arm of chromosome 10. Am. J. Hum. Genet. 41: 616-626, 1987.

2565. Greene, W. C.; Leonard, W. J.; Depper, J. M.; Nelson, D. L.; Waldmann, T. A.: The human interleukin-2 receptor: normal and abnormal expression in T cells and in leukemias induced by the human T-lymphotropic retroviruses. Ann. Intern. Med. 105: 560-572, 1986.

2566. Hatakeyama, M.; Minamoto, S.; Taniguchi, T.: Intracytoplasmic phosphorylation sites of Tac antigen (p55) are not essential for the conformation, function, and regulation of the human interleukin 2 receptor. Proc. Nat. Acad. Sci. 83: 9650-9654, 1986.

2567. Hatakeyama, M.; Minamoto, S.; Uchiyama, T.; Hardy, R. R.; Yamada, G.; Taniguchi, T.: Reconstitution of functional receptor for human interleukin-2 in mouse cells. Nature 318: 467-470, 1985.

2568. Ihle, J. N.; Kerr, I. M.: Jaks and Stats in signaling by the cytokine receptor superfamily. Trends Genet. 11: 69-74, 1995.

2569. Ishida, N.; Kanamori, H.; Noma, T.; Nikaido, T.; Sabe, H.; Suzuki, N.; Shimizu, A.; Honjo, T.: Molecular cloning and structure of the human interleukin 2 receptor gene. Nucleic Acids Res. 13: 7579-7589, 1985.

2570. Kondo, S.; Shimizu, A.; Maeda, M.; Tagaya, Y.; Yodoi, J.; Honjo, T.: Expression of functional human interleukin-2 receptor in mouse T cells by cDNA transfection. Nature 320: 75-77, 1986.

2571. Leonard, W. J.; Depper, J. M.; Crabtree, G. R.; Rudikoff, S.; Pumphrey, J.; Robb, R. J.; Kronke, M.; Svetlik, P. B.; Peffer, N. J.; Waldmann, T. A.; Greene, W. C.: Molecular cloning and expression of cDNAs for the human interleukin-2 receptor. Nature 311: 626-631, 1984.

2572. Chen, T.-R.; McMorris, F. A.; Creagan, R.; Ricciuti, F. C.; Tischfield, J.; Ruddle, F. H.: Assignment of the genes for malate oxidoreductase decarboxylating to chromosome 6 and peptidase B and lactate dehydrogenase B to chromosome 12 in man. Am. J. Hum. Genet. 25: 200-207, 1973.

2573. Hamerton, J. L.; Mohandas, T.; McAlpine, P. J.; Douglas, G. R.: Localization of human gene loci using spontaneous chromosome rearrangements in human-Chinese hamster somatic cell hybrids. Am. J. Hum. Genet. 27:595-608, 1975.

2574. Herbschleb-Voogt, E.; Meera Khan, P.: Defining the locus of origin of a genetically determined electrophoretic variant of a multilocus enzyme system; the Calcutta-1 of human LDH system is a B-locus variant. Hum. Genet. 57: 290-295, 1981.

2575. Houki, N.; Matsushima, Y.; Kitamura, M.; Tukada, T.; Nishina, T.; Nakayama, T.: A case of deficiency of lactate dehydrogenase H-subunit. Jpn. J. Clin. Chem. 15: 85-90, 1986.

2576. Kitamura, M.; Iijima, N.; Hashimoto, F.; Hiratsuka, A.: Hereditary deficiency of subunit H of lactate dehydrogenase. Clin. Chim. Acta 34:419-423, 1971.

2577. Maekawa, M.; Sudo, K.; Kitajima, M.; Matsuura, Y.; Li, S. S.-L.; Kanno, T.: Analysis of a genetic mutation in an electrophoretic variant of the human lactate dehydrogenase-B(H) subunit. Hum. Genet. 91:423-426, 1993.

2578. Maekawa, M.; Sudo, K.; Nagura, K.; Li, S. S.-L.; Kanno, T.: Population screening of lactate dehydrogenase deficiencies in Fukuoka Prefecture in Japan and molecular characterization of three independent mutations in the lactate dehydrogenase-B(H) gene. Hum. Genet. 93: 74-76, 1994.

2579. Malpuech, G.; Kaplan, J. C.; Rethore, M. O.; Junien, C.; Geneix, A.: Une observation de deletion partielle du bras court du chromosome 12: localisation du gene de la lacticodes hydrogenase B. Lyon Med. 233:275-279, 1975.

2580. Mayeda, K.; Weiss, L.; Lindahl, R.; Dully, M.: Localization of the human lactate dehydrogenase B gene on the short arm of chromosome 12. Am. J. Hum. Genet. 26: 59-64, 1974.

2581. Miwa, S.; Nishima, T.; Kanehashi, Y.; Kitamura, M.; Hiratsuka, A.; Shizume, K.: Studies on erythrocyte metabolism in a case with hereditary deficiency of H-subunit of lactate dehydrogenase. Acta Haemat. Jpn. 34: 228-232, 1971.

2582. Rasmussen, S. K.; Lautier, C.; Hansen, L.; Echwald, S. M.; Hansen, T.; Ekstrom, C. T.; Urhammer, S. A.; Borch-Johnsen, K.; Grigorescu, F.; Smith, R. J.; Pedersen, O.: Studies of the variability of the genes encoding the insulin-like growth factor I receptor and its ligand in relation to type 2 diabetes mellitus. J. Clin. Endocr. Metab. 85:1606-1610, 2000.

2583. Leonard, W. J.; Depper, J. M.; Kanehisa, M.; Kronke, M.; Peffer, N. J.; Svetlik, P. B.; Sullivan, M.; Greene, W. C.: Structure of the human interleukin-2 receptor gene. Science 230: 633-639, 1985.

2584. Leonard, W. J.; Depper, J. M.; Robb, R. J.; Waldmann, T. A.; Greene, W. C.: Characterization of the human receptor for T-cell growth factor. Proc. Nat. Acad. Sci. 80: 6957-6961, 1983.

2585. Marx, J. L.: The interleukin-2 receptor gene is cloned. Science 226:1064-1065, 1985.

2586. Nikaido, T.; Shimizu, A.; Ishida, N.; Sabe, H.; Teshigawara, K.; Maeda, M.; Uchiyama, T.; Yodoi, J.; Honjo, T.: Molecular cloning of a cDNA encoding human interleukin-2 receptor. Nature 311: 631-635, 1984.

2587. Robb, R. J.; Rusk, C. M.; Neeper, M. P.: Structure-function relationships for the interleukin 2 receptor: location of ligand and antibody binding sites on the Tac receptor chain by mutational analysis. Proc. Nat. Acad. Sci. 85: 5654-5658, 1988.

2588. Sharfe, N.; Dadi, H. K.; Shahar, M.; Roifman, C. M.: Human immune disorder arising from mutation of the alpha chain of the interleukin-2 receptor. Proc. Nat. Acad. Sci. 94: 3168-3171, 1997.

2589. Shevach, E. M.: Certified professionals: CD4(+)CD25 (+) suppressor T cells. J. Exp. Med. 193: F41-F45, 2001.

2590. Tsudo, M.; Kozak, R. W.; Goldman, C. K.; Waldmann, T. A.: Demonstration of a non-Tac peptide that binds interleukin 2: a potential participant in a multichain interleukin 2 receptor complex. Proc. Nat. Acad. Sci. 83: 9694-9698, 1986.

2591. Urdal, D. L.; March, C. J.; Gillis, S.; Larsen, A.; Dower, S. K.: Purification and chemical characterization of the receptor for interleukin 2 from activated human T lymphocytes and from a human T-cell lymphoma cell line. Proc. Nat. Acad. Sci. 81: 6481-6485, 1984.

2592. Mohrenweiser, H. W.; Neel, J. V.: Frequency of thermostability variants: estimation of total 'rare' variant frequency in human populations. Proc. Nat. Acad. Sci. 78: 5729-5733, 1981.

2593. Okumura, N.; Terasawa, F.; Ueno, I.; Oki, K.; Yamauchi, K.; Hidaka, H.; Tozuka, M.; Okura, M.; Katsuyama, T.: Genetic analyses in homozygous and heterozygous variants of lactate dehydrogenase-B (H) subunit: LD-B Matsumoto I and II (LD-B W323R). Clin. Chim. Acta 287: 163-171, 1999.

2594. Rethore, M.-O.; Junien, C.; Malpuech, G.; Baccichetti, C.; Tenconi, R.; Kaplan, J. C.; de Romeuf, J.; Lejeune, J.: Localisation du gene de la glyceraldehyde 3-phosphate dehydrogenase (G3PD) sur le segment distal du bras court du chromosome 12. Ann. Genet. 19: 140-142, 1976.

2595. Rethore, M.-O.; Kaplan, J.-C.; Junien, C.; Cruveiller, J.; Dutrillaux, B.; Aurias, A.; Carpentier, S.; Lafourcade, J.; Lejeune, J.: Augmentationde l'activite de la LDH-B chez un garcon trisomique 12p par malsegregationd'une translocation maternelle t(12;14)(q12;p11). Ann. Genet. 18:81-87, 1975.

2596. Sakai, I.; Sharief, F. S.; Pan, Y.-C. E.; Li, S. S.-L.: The cDNA and protein sequences of human lactate dehydrogenase B. Biochem. J. 248: 933-936, 1987.

2597. Santachiara, A. S.; Nabholz, M.; Miggiano, V.; Darlington, A. J.; Bodmer, W. F.: Linkage between human lactate dehydrogenase B and peptidase B genes. Nature 227: 248-251, 1970.

2598. Steinbach, P.; Rehder, H.: Tetrasomy for the short arm of chromosome 12 with accessory isochromosome (+i [12p]) and a marked LDH-B gene dosage effect. Clin. Genet. 32: 1-4, 1987.

2599. Sudo, K.: Personal Communication. Komae City, Japan Jul. 12, 1993.

2600. Sudo, K.; Maekawa, M.; Ikawa, S.; Machida, K.; Kitamura, M.; Li, S. S.-L.: A missense mutation found in human lactate dehydrogenase-B(H) variant gene. Biochem. Biophys. Res. Commun. 168: 672-676, 1990.

2601. Sudo, K.; Maekawa, M.; Luedemann, M. M.; Deaven, L. L.; Li, S. S.-L.: Human lactate dehydrogenase-B processed pseudo gene: nucleotide sequence analysis and assignment to the X-chromosome. Biochem. Biophys. Res. Commun. 171: 67-74, 1990.

2602. Sudo, K.; Maekawa, M.; Tomonaga, A.; Tsukada, T.; Nakayama, T.; Kitamura, M.; Li, S. S.-L.; Kanno, T.; Toriumi, J.: Molecular characterization of genetic mutations in human lactate dehydrogenase (LDH)B (H) variant. Hum. Genet. 89: 158-162, 1992.

2603. Van Someren, H.; Meera Khan, P.; Westerveld, A.; Bootsma, D.: Human genetics—two new linkage groups carrying different loci for LDH and glutamic-pyruvic transaminase found. Nature 240: 221-222, 1972.

2604. Weiss, L.; Mayeda, K.; Lindahl, R.; Dully, M.: Localization of human LDH-B gene of the short arm of chromosome 12. (Abstract) Am. J. Hum. Genet. 25: 85A only, 1973.

2605. Rajagopalan, H.; Bardelli, A.; Lengauer, C.; Kinzler, K. W.; Vogelstein, B.; Velculescu, V. E.: RAF/RAS oncogenes and mismatch-repair status. (Letter) Nature 418: 934 only, 2002.

2606. Zhong, S.; Delva, L.; Rachez, C.; Cenciarelli, C.; Gandini, D.; Zhang, H.; Kalantry, S.; Freedman, L. P.; Pandolfi, P. P.: A RA-dependent, tumour-growth suppressive transcription complex is the target of the PML-RAR-alpha and T18 oncoproteins. Nature Genet. 23: 287-295, 1999.

2607. Fukuyama, R.; Ichijoh, Y.; Minoshima, S.; Kitamura, N.; Shimizu, N.: Assignment of hepatocyte growth factor (HGF) gene to chromosome 7q21.1. (Abstract) Cytogenet. Cell Genet. 58: 1921 only, 1991.

2608. Fukuyama, R.; Ichijoh, Y.; Minoshima, S.; Kitamura, N.; Shimizu, N.: Regional localization of the hepatocyte growth factor (HGF) gene to human chromosome 7 band q21.1. Genomics 11: 410-415, 1991.

2609. Gherardi, E.; Stoker, M.: Hepatocytes and scatter factor. Nature 346:228 only, 1990.

2610. Gohda, E.; Tsubouchi, H.; Nakayama, H.; Hirono, S.; Sakiyama, O.; Takahashi, K.; Miyazaki, H.; Hashimoto, S.; Daikuhara, Y.: Purification and partial characterization of hepatocyte growth factor from plasma of a patient with fulminant hepatic failure. J. Clin. Invest. 81:414-419, 1988.

2611. Kilby, M. D.; Afford, S.; Li, X. F.; Strain, A. J.; Ahmed, A.; Whittle, M. J.: Localisation of hepatocyte growth factor and its receptor (c-met) protein and mRNA in human term placenta. Growth Factors 13: 133-139, 1996.

2612. Lai, L.; Goldschneider, I.: Cutting edge: identification of a hybrid cytokine consisting of IL-7 and the beta-chain of the hepatocyte growth factor/scatter factor. J. Immun. 167: 3550-3554, 2001.

2613. Maina, F.; Casagranda, F.; Audero, E.; Simeone, A.; Comoglio, P. M.; Klein, R.; Ponzetto, C.: Uncoupling of Grb2 from the Met receptor in vivo reveals complex roles in muscle development. Cell 87: 531-542, 1996.

2614. Miyazawa, K.; Tsubouchi, H.; Naka, D.; Takahashi, K.; Okigaki, M.; Arakaki, N.; Nakayama, H.; Hirono, S.; Sakiyama, O.; Takahashi, K.; Gohda, E.; Daikuhara, Y.; Kitamura, N.: Molecular cloning and sequence analysis of cDNA for human hepatocyte growth factor. Biochem. Biophys. Res. Commun. 163: 967-973, 1989.

2615. Nakamura, T.; Nishizawa, T.; Hagiya, M.; Seki, T.; Shimonishi, M.; Sugimura, A.; Tashiro, K.; Shimizu, S.: Molecular cloning and expression of human hepatocyte growth factor. Nature 342: 440-443, 1989.

2616. Noonan, F. P.; Recio, J. A.; Takayama, H.; Duray, P.; Anver, M. R.; Rush, W. L.; De Fabo, E. C.; Merlino, G.: Neonatal sunburn and melanoma in mice: severe sunburn in newborn, but not adult, mice is linked with melanoma in later life. Nature 413: 271-272, 2001.

2617. Powell, E. M.; Mars, W. M.; Levitt, P.: Hepatocyte growth factor/scatter factor is a motogen for interneurons migrating from the ventral to dorsal telencephalon. Neuron 30: 79-89, 2001.

2618. Rubin, J. S.; Chan, A. M.-L.; Bottaro, D. P.; Burgess, W. H.; Taylor, W. G.; Cech, A. C.; Hirschfield, D. W.; Wong, J.; Miki, T.; Finch, P. W.; Aaronson, S. A.: A broad-spectrum human lung fibroblast-derived mitogen is a variant of hepatocyte growth factor. Proc. Nat. Acad. Sci. 88: 415-419, 1991.

2619. Saccone, S.; Narsimhan, R. P.; Gaudino, G.; Dalpra, L.; Comoglio, P. M.; Della Valle, G.: Regional mapping of the human hepatocyte growth factor (HGF)-scatter factor gene to chromosome 7q21.1. Genomics 13:912-914, 1992.

2620. Schmidt, C.; Bladt, F.; Goedecke, S.; Brinkmann, V.; Zschiesche, W.; Sharpe, M.; Gherardi, E.; Birchmeier, C.: Scatter factor/hepatocyte growth factor is essential for liver development. Nature 373: 699-702, 1995.

2621. Uehara, Y.; Minowa, O.; Mori, C.; Shiota, K.; Kuno, J.; Noda, T.; Kitamura, N.: Placental defect and embryonic lethality in mice lacking hepatocyte growth factor/scatter factor. Nature 373: 702-705, 1995.

2622. Weidner, K. M.; Arakaki, N.; Hartmann, G.; Vandekerckhove, J.; Weingart, S.; Rieder, H.; Fonatsch, C.; Tsubouchi, H.; Hishida, T.; Daikuhara, Y.; Birchmeier, W.: Evidence for the identity of human scatter factor and human hepatocyte growth factor. Proc. Nat. Acad. Sci. 88: 7001-7005, 1991.

2623. Zarnegar, R.; Petersen, B.; DeFrances, M. C.; Michalopoulos, G.: Localization of hepatocyte growth factor (HGF) gene on human chromosome 7. Genomics 12: 147-150, 1992.

2624. Lafuse, W. P.; Zwilling, B. S.: Localization of the inhibin beta-B gene on mouse chromosome 1. Mammalian Genome 4: 399-400, 1993.

2625. Salmenkivi, K.; Arola, J.; Voutilainen, R.; Ilvesmaki, V.; Haglund, C.; Kahri, A. I.; Heikkila, P.; Liu, J.: Inhibin/activin beta-B-subunit expression in pheochromocytomas favors benign diagnosis. J. Clin. Endocr. Metab. 86: 2231-2235, 2001.

2626. Schrewe, H.; Gendron-Maguire, M.; Harbison, M. L.; Gridley, T.: Mice homozygous for a null mutation of activin beta B are viable and fertile. Mech. Dev. 47: 43-51, 1994.

2627. Nicoll, J. A. R.; Mrak, R. E.; Graham, D. I.; Stewart, J.; Wilcock, G.; MacGowan, S.; Esiri, M. M.; Murray, L. S.; Dewar, D.; Love, S.; Moss, T.; Griffin, W. S. T.: Association of interleukin-1 gene polymorphisms with Alzheimer's disease. Ann. Neurol. 47: 365-368, 2000.

2628. Rogers, J.: An IL-1-alpha susceptibility polymorphism in Alzheimer's disease: new fuel for the inflammation hypothesis. (Editorial) Neurology 55:464-465, 2000.

2629. Sabatino, M.; Boyce, B.; Aufdemorte, T.; Bonewald, L.; Mundy, G. R.: Infusions of recombinant human interleukins 1 alpha and 1 beta cause hypercalcemia in normal mice. Proc. Nat. Acad. Sci. 85:5235-5239, 1988.

2630. Silver, A. R. J.; Masson, W. K.; George, A. M.; Adam, J.; Cox, R.: The Il-1 alpha and beta genes are closely linked (less than 70 kb) on mouse chromosome 2. Somat. Cell Molec. Genet. 16: 549-556, 1990.

2631. Tanaka, A. R.; Ikeda, Y.; Abe-Dohmae, S.; Arakawa, R.; Sadanami, K.; Kidera, A.; Nakagawa, S.; Nagase, T.; Aoki, R.; Kioka, N.; Amachi, T.; Yokoyama, S.; Ueda, K.: Human ABCA1 contains a large amino terminal extracellular 2632. Chesi, M.; Nardini, E.; Brents, L. A.; Schrock, E.; Ried, T.; Kuehl, W. M.; Bergsagel, P. L.: Frequent translocation t(4; 14)(p16.3;q32.3) in multiple myeloma is associated with increased expression and activating mutations of fibroblast growth factor receptor 3. Nature Genet. 16:260-264, 1997.

2633. Baroni, M. G.; Oelbaum, R. S.; Pozzilli, P.; Stocks, J.; Li, S.-R.; Fiore, V.; Galton, D. J.: Polymorphisms at the GLUT1 (HepG2) and GLUT4 (muscle/adipocyte) glucose transporter genes and non-insulin-dependent diabetes mellitus (NIDDM). Hum. Genet. 88: 557-561, 1992.

2634. Kelley, M. J.; Pech, M.; Seuanez, H. N.; Rubin, J. S.; O'Brien, S. J.; Aaronson, S. A.: Emergence of the keratinocyte growth factor multigene family during the great ape radiation. Proc. Nat. Acad. Sci. 89: 9287-9291, 1992.

2635. Mattei, M.-G.; deLapeyriere, O.; Bresnick, J.; Dickson, C.; Birnbaum, D.; Mason, I.: Mouse Fgf7 (fibroblast growth factor 7) and Fgf8 (fibroblast growth factor 8) genes map to chromosomes 2 and 19 respectively. Mammalian Genome 6: 196-197, 1995.

2636. Rubin, J. S.; Osada, H.; Finch, P. W.; Taylor, W. G.; Rudikoff, S.; Aaronson, S. A.: Purification and characterization of a newly identified growth factor specific for epithelial cells. Proc. Nat. Acad. Sci. 86: 802-806, 1989.

2637. Werner, S.; Smola, H.; Liao, X.; Longaker, M. T.; Krieg, T.; Hofschneider, P. H.; Williams, L. T.: The function of KGF in morphogenesis of epithelium and reepithelialization of wounds. Science 266: 819-822, 1994.

2638. Zimonjic, D. B.; Kelley, M. J.; Rubin, J. S.; Aaronson, S. A.; Popescu, N. C.: Fluorescence in situ hybridization analysis of keratinocyte growth factor gene amplification and dispersion in evolution of great apes and humans. Proc. Nat. Acad. Sci. 94: 11461-11465, 1997.

2639. Nagase, T.; Seki, N.; Ishikawa, K.; Tanaka, A.; Nomura, N.: Prediction of the coding sequences of unidentified human genes. V. The coding sequences of 40 new genes (KIAA0161-KIAA0200) deduced by analysis of cDNA clones from human cell line KG-1. DNA Res. 3: 17-24, 1996.

2640. Bassi, M. T.; Ramesar, R. S.; Caciotti, B.; Winship, I. M.; DeGrandi, A.; Riboni, M.; Townes, P. L.; Beighton, P.; Ballabio, A.; Borsani, G.: X-linked late-onset sensorineural deafness caused by a deletion involving OA1 and a novel gene containing WD-40 repeats. Am. J. Hum. Genet. 64: 1604-1616, 1999.

2641. Converse, P. J.: Personal Communication. Baltimore, Md. Aug. 24, 2001.

2642. Disteche, C. M.; Dinulos, M. B.; Bassi, M. T.; Elliott, R. W.; Rugarli, E. I.: Mapping of the murine Tbl1 gene reveals a new rearrangement between mouse and human X chromosomes. Mammalian Genome 9: 1062-1064, 1998.

2643. Dong, X.; Tsuda, L.; Zavitz, K. H.; Lin, M.; Li, S.; Carthew, R. W.; Zipursky, S. L.: ebi regulates epidermal growth factor receptor signaling pathways in Drosophila. Genes Dev. 13: 954-965, 1999.

2644. Matsuzawa, S.; Reed, J. C.: Siah-1, SIP, and Ebi collaborate in a novel pathway for beta-catenin degradation linked to p53 responses. Molec. Cell 7: 915-926, 2001.

2645. Zhang, J.; Kalkum, M.; Chait, B. T.; Roeder, R. G.: The N-CoR-HDAC3 nuclear receptor corepressor complex inhibits the JNK pathway through the integral subunit GPS2. Molec. Cell 9: 611-623, 2002.

2646. Farndon, J. R.; Leight, G. S.; Dilley, W. G.; Baylin, S. B.; Smallridge, R. C.; Harrison, T. S.; Wells, S. A., Jr.: Familial medullary thyroid carcinoma without associated endocrinopathies: a distinct clinical entity. Brit. J. Surg. 73: 278-281, 1986.

2647. Ellis, S. A.; Palmer, M. S.; McMichael, A. J.: Human trophoblast and the choriocarcinoma cell line BeWo express a truncated HLA class I molecule. J. Immun. 144: 731-735, 1990.

2648. Geraghty, D. E.; Koller, B. H.; Orr, H. T.: A human major histocompatibility complex class I gene that encodes a protein with a shortened cytoplasmic segment. Proc. Nat. Acad. Sci. 84: 9145-9149, 1987.

2649. Geraghty, D. E.; Pei, J.; Lipsky, B.; Hansen, J. A.; Taillon-Miller, P.; Bronson, S. K.; Chaplin, D. D.: Cloning and physical mapping of the HLA class I region spanning the HLA-E-to-HLA-F interval by using yeast artificial chromosomes. Proc. Nat. Acad. Sci. 89: 2669-2673, 1992.

2650. Hurks, H. M. H.; Valter, M. M.; Wilson, L.; Hilgert, I.; van denElsen, P. J.; Jager, M. J.: Uveal melanoma: no expression of HLA-G. Invest. Ophthal. Vis. Sci. 42: 3081-3084, 2001.

2651. Kirszenbaum, M.; Moreau, P.; Gluckman, E.; Dausset, J.; Carosella, E.: An alternatively spliced form of HLA-G mRNA in human trophoblasts and evidence for the presence of HLA-G transcript in adult lymphocytes. Proc. Nat. Acad. Sci. 91: 4209-4213, 1994.

2652. Lila, N.; Carpentier, A.; Amrein, C.; Khalil-Daher, I.; Dausset, J.; Carosella, E. D.: Implication of HLA-G molecule in heart-graft acceptance. Lancet 355: 2138 only, 2000.

2653. McAlpine, P. J.: Personal Communication. Winnipeg, Manitoba, Canada Jun. 22, 1988.

2654. Morales, P.; Corell, A.; Martinez-Laso, J.; Martin-Villa, J. M.; Varela, P.; Paz-Artal, E.; Allende, L.-M.; Arnaiz-Villena, A.: Three new HLA-G alleles and their linkage disequilibria with HLA-A. Immunogenetics 38:323-331, 1993.

2655. Onno, M.; Guillaudeux, T.; Amiot, L.; Renard, I.; Drenou, B.; Hirel, B.; Girr, M.; Semana, G.; Le Bouteiller, P.; Fauchet, R.: The HLA-G gene is expressed at a low mRNA level in different human cells and tissues. Human Immun. 41: 79-86, 1994.

2656. Paul, P.; Rouas-Freiss, N.; Khalil-Daher, I.; Moreau, P.; Riteau, B.; Le Gal, F. A.; Avril, M. F.; Dausset, J.; Guillet, J. G.; Carosella, E. D.: HLA-G expression in melanoma: a way for tumor cells to escape from immunosurveillance. Proc. Nat. Acad. Sci. 95: 4510-4515, 1998.

2657. Rouas-Freiss, N.; Marchal, R. E.; Kirszenbaum, M.; Dausset, J.; Carosella, E. D.: The alphal domain of HLA-G1 and HLA-G2 inhibits cytotoxicity induced by natural killer cells: is HLA-G the public ligand for natural killer cell inhibitory receptors? Proc. Nat. Acad. Sci. 94: 5249-5254, 1997.

2658. Schmidt, C. M.; Orr, H. T.: A physical linkage map of HLA-A,-G, -7.5p, and -F. Hum. Immun. 31: 180-185, 1991.

2659. Heisler, L. K.; Cowley, M. A.; Tecott, L. H.; Fan, W.; Low, M. J.; Smart, J. L.; Rubinstein, M.; Tatro, J. B.; Marcus, J. N.; Holstege, H.; Lee, C. E.; Cone, R. D.; Elmquist, J. K.: Activation of central melanocortin pathways by fenfluramine. Science 297: 609-611, 2002.

2660. Swan, D. C.; McBride, O. W.; Robbins, K. C.; Keithley, D. A.; Reddy, E. P.; Aaronson, S. A.: Chromosomal mapping of the simian sarcoma virus onc gene analogue in human cells. Proc. Nat. Acad. Sci. 79: 4691-4695, 1982.

2661. Guru, S. C.; Agarwal, S. K.; Manickam, P.; Olufemi, S.-E.; Crabtree, J. S.; Weisemann, J. M.; Kester, M. B.; Kim, Y. S.; Wang, Y.; Emmert-Buck, M. R.; Liotta, L. A.;

2661. Spiegel, A. M.; Boguski, M. S.; Roe, B. A.; Collins, F. S.; Marx, S. J.; Burns, L.; Chandrasekharappa, S. C.: A transcript map for the 2.8-Mb region containing the multiple endocrineneoplasia type 1 locus. Genome Res. 7: 725-735, 1997.
2662. Van Leeuwen, A.: Di-allelic allo-antigenic systems on human T-lymphocyte subsets. Thesis: London Hospital Medical College (pub.) 1982.
2663. Walker, I. D.; Sandrin, M. S.; Hogarth, P. M.; Sutton, V. R.; McKenzie, I. F. C.: Expression of Qa alloantigens on peripheral T cells: the relationship of the Qa-m2, 7, 8, 9 specificities. Immunogenetics 24:90-94, 1986.
2664. Yokoyama, W. M.: The mother-child union: the case of missing-self and protection of the fetus. Proc. Nat. Acad. Sci. 94: 5998-6000, 1997.
2665. Aizawa, S.; Nakano, H.; Ishida, T.; Horie, R.; Nagai, M.; Ito, K.; Yagita, H.; Okumura, K.; Inoue, J.; Watanabe, T.: Tumor necrosis factor receptor-associated factor (TRAF) 5 and TRAF2 are involved in CD30-mediated NF-kappa-B activation. J. Biol. Chem. 272: 2042-2045, 1997.
2666. Gregor, P.; Reeves, R. H.; Jabs, E. W.; Yang, X.; Dackowski, W.; Rochelle, J. M.; Brown, R. H., Jr.; Haines, J. L.; O'Hara, B. F.; Uhl, G. R.; Seldin, M. F.: Chromosomal localization of glutamate receptor genes: relationship to familial amyotrophic lateral sclerosis and other neurological disorders of mice and humans. Proc. Nat. Acad. Sci. 90: 3053-3057, 1993.
2667. Sun, W.; Ferrer-Montiel, A. V.; Schinder, A. F.; McPherson, J. P.; Evans, G. A.; Montal, M.: Molecular cloning, chromosomal mapping, and functional expression of human brain glutamate receptors. Proc. Nat. Acad. Sci. 89: 1443-1447, 1992.
2668. Anderson, L. A.; Friedman, L.; Osborne-Lawrence, S.; Lynch, E.; Weissenbach, J.; Bowcock, A.; King, M.-C.: High-density genetic map of the BRCA1 region of chromosome 17q12-q21. Genomics 17: 618-623, 1993.
2669. Zurawski, S. M.; Vega, F., Jr.; Huyghe, B.; Zurawski, G.: Receptors for interleukin-13 and interleukin-4 are complex and share a novel component that functions in signal transduction. EMBO J. 12: 2663-2670, 1993.
2670. Aleman, A.; Verhaar, H. J. J.; De Haan, E. H. F.; De Vries, W. R.; Samson, M. M.; Drent, M. L.; Van Der Veen, E. A.; Koppeschaar, H. P. F.: Insulin-like growth factor-I and cognitive function in healthy older men. J. Clin. Endocr. Metab. 84: 471-475, 1999.
2671. Baker, J.; Liu, J.-P.; Robertson, E. J.; Efstratiadis, A.: Role of insulin-like growth factors in embryonic and postnatal growth. Cell 75:73-82, 1993.
2672. Bowcock, A.; Sartorelli, V.: Polymorphism and mapping of the IGF1 gene, and absence of association with stature among African Pygmies. Hum. Genet. 85: 349-354, 1990.
2673. Camacho-Hubner, C.; Woods, K. A.; Miraki-Moud, F.; Hindmarsh, P. C.; Clark, A. J.; Hansson, Y.; Johnston, A.; Baxter, R. C.; Savage, M. O.: Effects of recombinant human insulin-like growth factor I(IGF-I) therapy on the growth hormone-IGF system of a patient with a partial IGF-I gene deletion. J. Clin. Endocr. Metab. 84: 1611-1616, 1999.
2674. Goddard, A. D.; Covello, R.; Luoh, S.-M.; Clackson, T.; Attie, K. M.; Gesundheit, N.; Rundle, A. C.; Wells, J. A.; Carlsson, L. M. S.: Mutations of the growth hormone receptor in children with idiopathic short stature. New Eng. J. Med. 333: 1093-1098, 1995.
2675. Guler, H.-P.; Binz, K.; Eigenmann, E.; Jaggi, S.; Zimmermann, D.; Zapf, J.; Froesch, E. R.: Small stature and insulin-like growth factors: prolonged treatment of minipoodles with recombinant human insulin-like growth factor 1. Acta Endocr. 121: 456-464, 1989.
2676. Garland, D.; Rao, P. V.; Del Corso, A.; Mura, U.; Zigler, J. S. Jr.: Zeta-crystallin is a major protein in the lens of Camelus dromedarius. Arch. Biochem. Biophys. 285: 134-136, 1991.
2677. Gonzalez, P.; Rao, P. V.; Zigler, J. S., Jr.: Organization of the human zeta-crystallin/quinone reductase gene (CRYZ). Genomics 21:317-324, 1994.
2678. Heinzmann, C.; Kojis, T. L.; Gonzalez, P.; Rao, P. V.; Zigler, J. S., Jr.; Polymeropoulos, M. H.; Klisak, I.; Sparkes, R. S.; Mohandas, T.; Bateman, J. B.: Assignment of the zeta-crystallin gene (CRYZ) to human chromosome 1p22-p31 and identification of restriction fragment length polymorphisms. Genomics 23: 403-407, 1994.
2679. Huang, Q.-L.; Russell, P.; Stone, S. H.; Zigler, J. S., Jr.: Zeta-crystallin, a novel lens protein from the guinea pig. Curr. Eye Res. 6: 725-732, 1987.
2680. Rodriguez, I. R.; Gonzalez, P.; Zigler, J. S., Jr.; Borras, T.: A guinea-pig hereditary cataract contains a splice site deletion in a crystallin gene. Biochim. Biophys. Acta 1180: 44-52, 1992.
2681. Kremmidiotis, G.; Baker, E.; Crawford, J.; Eyre, H. J.; Nahmias, J.; Callen, D. F.: Localization of human cadherin genes to chromosome regions exhibiting cancer-related loss of heterozygosity. Genomics 49:467-471, 1998.
2682. Clayerie, J.-M.; Hardelin, J.-P.; Legouis, R.; Levilliers, J.; Bougueleret, L.; Mattei, M.-G.; Petit, C.: Characterization and chromosomal assignment of a human cDNA encoding a protein related to the murine 102-kDa cadherin-associated protein (alpha-catenin). Genomics 15:13-20, 1993.
2683. Cook, S. A.; Bronson, R. T.; Donahue, L. R.; Ben-Arie, N.; Davisson, M. T.: Cerebellar deficient folia (cdf): a new mutation on mouse chromosome 6. Mammalian Genome 8: 108-112, 1997.
2684. Herrenknecht, K.; Ozawa, M.; Eckerskorn, C.; Lottspeich, F.; Lenter, M.; Kemler, R.: The uvomorulin-anchorage protein alpha-catenin is a vinculin homologue. Proc. Nat. Acad. Sci. 88: 9156-9160, 1991.
2685. Park, C.; Falls, W.; Finger, J. H.; Longo-Guess, C. M.; Ackerman, S. L.: Deletion in Catna2, encoding alphaN-catenin, causes cerebellar and hippocampal lamination defects and impaired startle modulation. Nature Genet. 31: 279-284, 2002.
2686. Hanson, I.; Churchill, A.; Love, J.; Axton, R.; Moore, T.; Clarke, M.; Meire, F.; van Heyningen, V.: Missense mutations in the most ancient residues of the PAX6 paired domain underlie a spectrum of human congenital eye malformations. Hum. Molec. Genet. 8: 165-172, 1999.
2687. Martin-Subero, J. I.; Gesk, S.; Harder, L.; Sonoki, T.; Tucker, P. W.; Schlegelberger, B.; Grote, W.; Novo, F. J.; Calasanz, M. J.; Hansmann, M. L.; Dyer, M. J. S.; Siebert, R.: Recurrent involvement of the REL and BCL11A loci in classical Hodgkin lymphoma. Blood 99:1474-1477, 2002.
2688. Hankinson, S. E.; Willett, W. C.; Colditz, G. A.; Hunter, D. J.; Michaud, D. S.; Deroo, B.; Rosner, B.; Speizer, F. E.; Pollak, M.: Circulating concentrations of insulin-like growth factor-I and risk of breast cancer. Lancet 351: 1393-1396, 1998.
2689. Emi, M.; Asaoka, H.; Matsumoto, A.; Itakura, H.; Kurihara, Y.; Wada, Y.; Kanamori, H.; Yazaki, Y.; Takahashi, E.; Lepert, M.; Lalouel, J.-M.; Kodama, T.; Mukai, T.: Structure, organization, and chromosomal mapping of the human macrophage scavenger receptor gene. J. Biol. Chem. 268: 2120-2125, 1993.

2690. Latil, A.; Lidereau, R.: Genetic aspects of prostate cancer. Virchows Arch. 432: 389-406, 1998.
2691. Matsumoto, A.; Naito, M.; Itakura, H.; Ikemoto, S.; Asaoka, H.; Hayakawa, I.; Kanamori, H.; Aburatani, H.; Takaku, F.; Suzuki, H.; Kobari, Y.; Miyai, T.; Takahashi, K.; Cohen, E. H.; Wydro, R.; Housman, D. E.; Kodama, T.: Human macrophage scavenger receptors: primary structure, expression, and localization in atherosclerotic lesions. Proc. Nat. Acad. Sci. 87: 9133-9137, 1990.
2692. Xu, J.; Zheng, S. L.; Hawkins, G. A.; Faith, D. A.; Kelly, B.; Isaacs, S. D.; Wiley, K. E.; Chang, B.; Ewing, C. M.; Bujnovszky, P.; Carpten, J. D.; Bleecker, E. R.; Walsh, P. C.; Trent, J. M.; Meyers, D. A.; Isaacs, W. B.: Linkage and association studies of prostate cancer susceptibility: evidence for linkage at 8p22-23. Am. J. Hum. Genet. 69: 341-350, 2001.
2693. Xu, J.; Zheng, S. L.; Komiya, A.; Mychaleckyj, J. C.; Isaacs, S. D.; Hu, J. J.; Sterling, D.; Lange, E. M.; Hawkins, G. A.; Turner, A.; Ewing, C. M.; Faith, D. A.; and 19 others: Germline mutations and sequence variants of the macrophage scavenger receptor 1 gene are associated with prostate cancer risk. Nature Genet. 32: 321-325, 2002.
2694. Harman, S. M.; Metter, E. J.; Blackman, M. R.; Landis, P. K.; Carter, H. B.: Serum levels of insulin-like growth factor I (IGF-I), IGF-II, IGF-binding protein-3, and prostate-specific antigen as predictors of clinical prostate cancer. J. Clin. Endocr. Metab. 85: 4258-4265, 2000.
2695. Holly, J.: Insulin-like growth factor-I and new opportunities for cancer prevention. Lancet 351: 1373-1375, 1998.
2696. Hoppener, J. W. M.; de Pagter-Holthuizen, P.; Geurts van Kessel, A. H. M.; Jansen, M.; Kittur, S. D.; Antonarakis, S. E.; Lips, C. J. M.; Sussenbach, J. S.: The human gene encoding insulin-like growth factor I is located on chromosome 12. Hum. Genet. 69: 157-160, 1985.
2697. Le Bouc, Y.; Dreyer, D.; Jaeger, F.; Binoux, M.; Sondermeyer, P.: Complete characterization of the human IGFI nucleotide sequence isolated from a newly constructed adult liver cDNA library. FEBS Lett. 196: 108-112, 1986.
2698. Hellstrom, A.; Perruzzi, C.; Ju, M.; Engstrom, E.; Hard, A.-L.; Liu, J.-L.; Albertsson-Wikland, K.; Carlsson, B.; Niklasson, A.; Sjodell, L.; LeRoith, D.; Senger, D. R.; Smith, L. E. H.: Low IGF-I suppresses VEGF-survival signaling in retinal endothelial cells: direct correlation with clinical retinopathy of prematurity. Proc. Nat. Acad. Sci. 98:5804-5808, 2001.
2699. Lembo, G.; Rockman, H. A.; Hunter, J. J.; Steinmetz, H.; Koch, W. J.; Ma, L.; Printz, M. P.; Ross, J., Jr.; Chien, K. R.; Powell-Braxton, L.: Elevated blood pressure and enhanced myocardial contractilityin mice with severe IGF-1 deficiency. J. Clin. Invest. 98: 2648-2655, 1996.
2700. Li, C. H.; Yamashiro, D.; Gospodarowicz, D.; Kaplan, S. L.; Van Vliet, G.: Total synthesis of insulin-like growth factor I (somatomedin C). Proc. Nat. Acad. Sci. 80: 2216-2220, 1983.
2701. Liu, J.-P.; Baker, J.; Perkins, A. S.; Robertson, E. J.; Efstratiadis, A.: Mice carrying null mutations of the genes encoding insulin-like growth factor I (Igf-1) and type 1 IGF receptor (Igf1r). Cell 75:59-72, 1993.
2702. Mathews, L. S.; Norstedt, G.; Palmiter, R. D.: Regulation of insulin-like growth factor I gene expression by growth hormone. Proc. Nat. Acad. Sci. 83: 9343-9347, 1986.
2703. Morton, C.; Rall, L.; Bell, G.; Shows, T.: Human insulin-like growth factor-1 (IGF1) is encoded at 12q22-q24.1, and insulin-like growth factor-2 (IGF2) is at 11p15. (Abstract) Cytogenet. Cell Genet. 40:703 only, 1985.
2704. Musaro, A.; McCullagh, K.; Paul, A.; Houghton, L.; Dobrowolny, G.; Molinaro, M.; Barton, E. R.; Sweeney, H. L.; Rosenthal, N.: Localized Igf-1 transgene expression sustains hypertrophy and regeneration insenescent skeletal muscle. Nature Genet. 27: 195-200, 2001.
2705. Musaro, A.; McCullagh, K. J. A.; Naya, F. J.; Olson, E. N.; Rosenthal, N.: IGF-1 induces skeletal myocyte hypertrophy through calcineurin in association with GATA-2 and NF-ATc1. Nature 400: 581-585, 1999.
2706. Playford, M. P.; Bicknell, D.; Bodmer, W. F.; Macaulay, V. M.: Insulin-like growth factor 1 regulates the location, stability, and transcriptional activity of betacatenin. Proc. Nat. Acad. Sci. 97:12103-12108, 2000.
2707. Powell-Braxton, L.; Hollingshead, P.; Warburton, C.; Dowd, M.; Pitts-Meek, S.; Dalton, D.; Gillett, N.; Stewart, T. A.: IGF-I is required for normal embryonic growth in mice. Genes Dev. 7: 2609-2617, 1993.
2708. Rapp, R.; Deger, A.; Blum, W.; Koch, R.; Weber, U.: Characterization of the protein which binds insulin-like growth factor in human serum. Europ. J. Biochem. 172: 421-425, 1988.
2709. Rotwein, P.: Two insulin-like growth factor I messenger RNAs are expressed in human liver. Proc. Nat. Acad. Sci. 83: 77-81, 1986.
2710. Schoenle, E. J.; Zenobi, P. D.; Torresani, T.; Werder, E. A.; Zachmann, M.; Froesch, E. R.: Recombinant human insulin-like growth factor I (rhIGF I) reduces hyperglycaemia in patients with extreme insulin resistance. Diabetologia 34: 675-679, 1991.
2711. Semsarian, C.; Wu, M.-J.; Ju, Y.-K.; Marciniec, T.; Yeoh, T.; Allen, D. G.; Harvey, R. P.; Graham, R. M.: Skeletal muscle hypertrophy is mediated by a Ca(2+)-dependent calcineurin signalling pathway. Nature 400:576-581, 1999.
2712. Svoboda, M. E.; Van Wyk, J. J.; Klapper, D. G.; Fellows, R. E.; Grissom, F. E.; Schleuter, R. J.: Purification of somatomedin-C from human plasma: chemical and biological properties, partial sequence analysis, and relationship to other somatomedins. Biochemistry 19:790-797, 1980.
2713. Taylor, B. A.; Grieco, D.: Localization of the gene encoding insulin-like growth factor I on mouse chromosome 10. Cytogenet. Cell Genet. 56: 57-58, 1991.
2714. Tricoli, J. V.; Rall, L. B.; Scott, J.; Bell, G. I.; Shows, T. B.: Insulin-like growth factor genes: chromosome organization and association with disease. (Abstract) Am. J. Hum. Genet. 36: 121Sonly, 1984.
2715. Tricoli, J. V.; Rall, L. B.; Scott, J.; Bell, G. I.; Shows, T. B.: Localization of insulin-like growth factor genes to human chromosomes 11 and 12. Nature 310: 784-786, 1984.
2716. Ullrich, A.; Berman, C. H.; Dull, T. J.; Gray, A.; Lee, J. M.: Isolation of the human insulin-like growth factor I gene using a single synthetic DNA probe. EMBO J. 3: 361-364, 1984.
2717. Thomas, J. T.; Kilpatrick, M. W.; Lin, K.; Erlacher, L.; Lembessis, P.; Costa, T.; Tsipouras, P.; Luyten, F. P.: Disruption of human limb morphogenesis by a dominant negative mutation in CDMP1. Nature Genet. 58-64, 1997.
2718. Fryns, J. P.; van den Berghe, K.; van Assche, A.; van den Berghe, H.: Prenatal diagnosis of campomelic dwarfism. Clin. Genet. 19:199-201, 1981.
2719. Mellows, H. J.; Pryse-Davies, J.; Bennett, M. J.; Carter, C. O.: The camptomelic syndrome in two female siblings. Clin. Genet. 18:137-141, 1980.

2720. Xu, L.; Xia, J.; Jiang, H.; Zhou, J.; Li, H.; Wang, D.; Pan, Q.; Long, Z.; Fan, C.; Deng, H.-X.: Mutation analysis of hereditary multiple exostoses in the Chinese. Hum. Genet. 105: 45-50, 1999.

2721. Simmons, A. D.; Musy, M. M.; Lopes, C. S.; Hwang, L.-Y.; Yang, Y.-P.; Lovett, M.: A direct interaction between EXT proteins and glycosyltransferases is defective in hereditary multiple exostoses. Hum. Molec. Genet. 8: 2155-2164, 1999.

2722. Bevilacqua, M.; Butcher, E.; Furie, B.; Furie, B.; Gallatin, M.; Gimbrone, M.; Harlan, J.; Kishimoto, K.; Lasky, L.; McEver, R.; Paulson, J.; Rosen, S.; Seed, B.; Siegelman, M.; Springer, T.; Stoolman, L.; Tedder, T.; Varki, A.; Wagner, D.; Weissman, I.; Zimmerman, G.: Selectins: a family of adhesion receptors. (Letter) Cell 67: 233 only, 1991.

2723. Bevilacqua, M. P.; Stengelin, S.; Gimbrone, M. A., Jr.; Seed, B.: Endothelial leukocyte adhesion molecule 1: an inducible receptor for neutrophils related to complement regulatory proteins and lectins. Science 243:1160-1165, 1989.

2724. Collins, T.; Williams, A.; Johnston, G. I.; Kim, J.; Eddy, R.; Shows, T.; Gimbrone, M. A., Jr.; Bevilacqua, M. P.: Structure and chromosomal location of the gene for endothelial-leukocyte adhesion molecule 1. J. Biol. Chem. 266: 2466-2473, 1991.

2725. DeLisser, H. M.; Christofidou-Solomidou, M.; Sun, J.; Nakada, M. T.; Sullivan, K. E.: Loss of endothelial surface expression of E-selectin in a patient with recurrent infections. Blood 94: 884-894, 1999.

2726. Wang, N.; Chintala, S. K.; Fini, M. E.; Schuman, J. S.: Activation of a tissue-specific stress response in the aqueous outflow pathway of the eye defines the glaucoma disease phenotype. Nature Med. 7:304-309, 2001.

2727. Watson, M. L.; Kingsmore, S. F.; Johnston, G. I.; Siegelman, M. H.; Le Beau, M. M.; Lemons, R. S.; Bora, N. S.; Howard, T. A.; Weissman, I. L.; McEver, R. P.; Seldin, M. F.: Genomic organization of the selectin family of leukocyte adhesion molecules on human and mouse chromosome 1. J. Exp. Med. 172: 263-272, 1990.

2728. Wenzel, K.; Felix, S.; Kleber, F. X.; Brachold, R.; Menke, T.; Schattke, S.; Schulte, K. L.; Glaser, C.; Rohde, K.; Baumann, G.; Speer, A.: E-selectin polymorphism and atherosclerosis: an association study. Hum. Molec. Genet. 3: 1935-1937, 1994.

2729. Zheng, F.; Chevalier, J. A.; Zhang, L. Q.; Virgil, D.; Ye, S. Q.; Kwiterovich, P. O.: An Hphl polymorphism in the E-selectin gene is associated with premature coronary artery disease. Clin. Genet. 59:58-64, 2001.

2730. Eckenstein, F. P.: Fibroblast growth factors in the nervous system. J. Neurobiol. 25: 1467-1480, 1994.

2731. Jung, J.; Zheng, M.; Goldfarb, M.; Zaret, K. S.: Initiation of mammalian liver development from endoderm by fibroblast growth factors. Science 284:1998-2003, 1999.

2732. Mergia, A.; Eddy, R.; Abraham, J. A.; Fiddes, J. C.; Shows, T. B.: The genes for basic and acidic fibroblast growth factors are on different human chromosomes. Biochem. Biophys. Res. Commun. 138:644-651, 1986.

2733. Plotnikov, A. N.; Hubbard, S. R.; Schlessinger, J.; Mohammadi, M.: Crystal structures of two FGF-FGFR complexes reveal the determinants of ligand-receptor specificity. Cell 101: 413-424, 2000.

2734. Willecke, K.; Jungbluth, S.; Dahl, E.; Hennemann, H.; Heynkes, R.; Grzeschik, K.-H.: Six genes of the human connexin gene family coding for gap junctional proteins are assigned to four different human chromosomes. Europ. J. Cell Biol. 53: 275-280, 1990.

2735. Oviedo-Orta, E.; Hoy, T.; Evans, W. H.: Intercellular communication in the immune system: differential expression of connexin 40 and 43, and perturbation of gap junction channel functions in peripheral blood and tonsil human lymphocyte subpopulations. Immunology 99: 578-590, 2000.

2736. Britz-Cunningham, S. H.; Shah, M. M.; Zuppan, C. W.; Fletcher, W. H.: Mutations of the connexin 43 gap junction gene in patients with heart malformations and defects of laterality. New Eng. J. Med. 332:1323-1329, 1995.

2737. Brueckner, M.; D'Eustachio, P.; Horwich, A. L.: Linkage mapping of a mouse gene, iv, that controls left-right asymmetry of the heart and viscera. Proc. Nat. Acad. Sci. 86: 5035-5038, 1989.

2738. Burdine, R. D.; Schier, A. F.: Conserved and divergent mechanisms in left-right axis formation. Genes Dev. 14: 763-776, 2000.

2739. Casey, B.; Ballabio, A.: Connexin 43 mutations in sporadic and familial defects of laterality. (Letter) New Eng. J. Med. 333: 941, 1995.

2740. Corcos, I. A.; Meese, E. U.; Loch-Caruso, R.: Human connexin 43 gene locus, GJA1, sublocalized to band 6q21-q23.2. Cytogenet. Cell Genet. 64: 31-32, 1993.

2741. Debrus, S.; Tuffery, S.; Matsuoka, R.; Galal, O.; Sarda, P.; Sauer, U.; Bozio, A.; Tanman, B.; Toutain, A.; Claustres, M.; Le Paslier, D.; Bouvagnet, P.: Lack of evidence for connexin 43 gene mutations in human autosomal recessive lateralization defects. J. Molec. Cell. Cardiol. 29: 1423-1431, 1997.

2742. Wijnen, J. T.; Oldenburg, M.; Bloemendal, H.; Meera Khan, P.: GS(gamma-S)-crystallin (CRYGS) assignment to chromosome 3. (Abstract) Cytogenet. Cell Genet. 51: 1108 only, 1989.

2743. Chen, L. Z.; Harris, P. C.; Apostolou, S.; Baker, E.; Holman, K.; Lane, S. A.; Nancarrow, J. K.; Whitmore, S. A.; Stallings, R. L.; Hildebrand, C. E.; Richards, R. I.; Sutherland, G. R.; Callen, D. F.: A refined physical map of the long arm of human chromosome 16. Genomics 10:308-312, 1991.

2744. Albrecht, F. E.; Drago, J.; Felder, R. A.; Printz, M. P.; Eisner, G. M.; Robillard, J. E.; Sibley, D. R.; Westphal, H. J.; Jose, P. A.: Role of the D-1A dopamine receptor in the pathogenesis of genetic hypertension. J. Clin. Invest. 97: 2283-2288, 1996.

2745. Bermak, J. C.; Li, M.; Bullock, C.; Zhou, Q.-Y.: Regulation of transport of the dopamine D1 receptor by a new membrane-associated ER protein. Nature Cell Biol. 3: 492-498, 2001.

2746. Boultwood, J.; Lewis, M. S.; Wainscoat, J. S.: Physical linkage of glucocorticoid receptor (GRL) and dopamine D1 receptor (DRD1) on the long arm of chromosome 5. (Abstract) Cytogenet. Cell Genet. 58:1894 only, 1991.

2747. Castner, S. A.; Williams, G. V.; Goldman-Rakic, P. S.: Reversal of antipsychotic-induced working memory deficits by short-term dopamine D1 receptor stimulation. Science 287: 2020-2022, 2000.

2748. Dearry, A.; Gingrich, J. A.; Falardeau, P.; Fremeau, R. T., Jr.; Bates, M. D.; Caron, M. G.: Molecular cloning and expression of the gene for a human D(1) dopamine receptor. Nature 347: 72-76, 1990.

2749. Grandy, D. K.; Zhou, Q.-Y.; Allen, L.; Litt, R.; Magenis, R. E.; Civelli, O.; Litt, M.: A human D(1) dopamine receptor gene is located on chromosome 5 at q35.1 and identifies an EcoRI RFLP. Am. J. Hum. Genet. 47: 828-834, 1990.

2750. Krushkal, J.; Xiong, M.; Ferrell, R.; Sing, C. F.; Turner, S. T.; Boerwinkle, E.: Linkage and association of adrenergic and dopamine receptor genes in the distal portion of the long arm of chromosome 5 with systolic blood pressure variation. Hum. Molec. Genet. 7:1379-1383, 1998.

2751. Mayerhofer, A.; Hemmings, H. C., Jr.; Snyder, G. L.; Greengard, P.; Boddien, S.; Berg, U.; Brucker, C.: Functional dopamine-1 receptors and DARPP-32 are expressed in human ovary and granulosa luteal cells in vitro. J. Clin. Endocr. Metab. 84: 257-264, 1999.

2752. Sunahara, R. K.; Niznik, H. B.; Weiner, D. M.; Stormann, T. M.; Brann, M. R.; Kennedy, J. L.; Gelernter, J. E.; Rozmahel, R.; Yang, Y.; Israel, Y.; Seeman, P.; O'Dowd, B. F.: Human dopamine D1 receptor encoded by an intronless gene on chromosome 5. Nature 347: 80-83, 1990.

2753. Wilkie, T. M.; Chen, Y.; Gilbert, D. J.; Moore, K. J.; Yu, L.; Simon, M. I.; Copeland, N. G.; Jenkins, N. A.: Identification, chromosomal location, and genome organization of mammalian G-protein-coupled receptors. Genomics 18:175-184, 1993.

2754. Xu, M.; Moratalla, R.; Gold, L. H.; Hiroi, N.; Koob, G. F.; Graybiel, A. M.; Tonegawa, S.: Dopamine D1 receptor mutant mice are deficient in striatal expression of dynorphin and in dopamine-mediated behavioral responses. Cell 79: 729-742, 1994.

2755. Zhou, Q.-Y.; Grandy, D. K.; Thambi, L.; Kushner, J. A.; Van Tol, H. H. M.; Cone, R.; Pribnow, D.; Salon, J.; Bunzow, J. R.; Civelli, O.: Cloning and expression of human and rat D(1) dopamine receptors. Nature 347:76-80, 1990.

2756. Fan, Y.-S.; Eddy, R. L.; Byers, M. G.; Haley, L. L.; Henry, W. M.; Kayano, T.; Shows, T. B.; Bell, G. I.: Assignment of genes encoding three human glucose transporter/transporter-like proteins (GLUT4, GLUT5 and GLUT6) to chromosomes 17, 1 and 5, respectively. (Abstract) Cytogenet. Cell Genet. 51: 997 only, 1989.

2757. Aitken, D. A.; Ferguson-Smith, M. A.: Gene dosage evidence for the regional assignment of the GOT-S structural gene locus to 10q24-10q25. Cytogenet. Cell Genet. 22: 468-471, 1978.

2758. Creagan, R.; Tischfield, J.; McMorris, F. A.; Chen, S.-H.; Hirschi, M.; Chen, T.-T.; Ricciuti, F.; Ruddle, F. H.: Assignment of the genes for human peptidase A to chromosome 18 and cytoplasmic glutamic oxaloacetate-transaminase to chromosome 10 using somatic-cell hybrids. Cytogenet. Cell Genet. 12: 187-198, 1973.

2759. Ford, G. C.; Eichele, G.; Jansonius, J. N.: Three-dimensional structure of a pyridoxal-phosphate-dependent enzyme, mitochondrial aspartate aminotransferase. Proc. Nat. Acad. Sci. 77: 2559-2563, 1980.

2760. Gitelman, B. J.; Tomkins, D. J.; Partington, M. W.; Roberts, M. H.; Simpson, N. E.: Gene dosage studies of glutamic oxaloacetic transaminase (GOT) and hexokinase (HK) in two patients with possible partial trisomy10q. (Abstract) Am. J. Hum. Genet. 32: 41A only, 1980.

2761. Junien, C.; Despoisse, S.; Turleau, C.; de Grouchy, J.; Bucher, T.; Fundele, R.: Assignment of phosphoglycerate mutase (PGAMA) to human chromosome 10: regional mapping of GOT1 and PGAMA to sub bands 10q26.1 (or q25.3). Ann. Genet. 25: 25-27, 1982.

2762. Overhauser, J.; Mewar, R.; Rojas, K.; Lia, K.; Kline, A. D.; Silverman, G. A.: STS map of genes and anonymous DNA fragments on human chromosome 18 using a panel of somatic cell hybrids. Genomics 15: 387-391, 1993.

2763. Koch, G.; Lalley, P. A.; McAvoy, M.; Shows, T. B.: Assignment of LIPA, associated with human acid lipase deficiency, to human chromosome 10 and comparative assignment to mouse chromosome 19. Somat. Cell Genet. 7: 345-358, 1981.

2764. Asada, H.; Kawamura, Y.; Maruyama, K.; Kume, H.; Ding, R.-G.; Ji, F. Y.; Kanbara, N.; Kuzume, H.; Sanbo, M.; Yagi, T.; Obata, K.: Mice lacking the 65 kDa isoform of glutamic acid decarboxylase (GAD65) maintain normal levels of GAD67 and GABA in their brains but are susceptible to seizures. Biochem. Biophys. Res. Commun. 229: 891-895, 1996.

2765. Bu, D.-F.; Erlander, M. G.; Hitz, B. C.; Tillakaratne, N. J. K.; Kaufman, D. L.; Wagner-McPherson, C. B.; Evans, G. A.; Tobin, A. J.: Two human glutamate decarboxylases, 65-kDa GAD and 67-kDa GAD, are each encoded by a single gene. Proc. Nat. Acad. Sci. 89: 2115-2119, 1992.

2766. Edelhoff, S.; Grubin, C. E.; Karlsen, A. E.; Adler, D. A.; Foster, D.; Disteche, C. M.; Lernmark, A.: Mapping of glutamic acid decarboxylase (GAD) genes. Genomics 17: 93-97, 1993.

2767. McKusick, V. A.: The morbid anatomy of the human genome: a review of gene mapping in clinical medicine (part 1). Medicine 65: 1-33, 1986.

2768. Panteghini, M.: Aspartate aminotransferase isoenzymes. Clin. Biochem. 23: 311-319, 1990.

2769. Pol, S.; Bousquet-Lemercier, B.; Pave-Preux, M.; Bulle, F.; Passage, E.; Hanoune, J.; Mattei, M. G.; Barouki, R.: Chromosomal localization of human aspartate aminotransferase genes by in situ hybridization. Hum. Genet. 83: 159-164, 1989.

2770. Scott, E. M.; Wright, R. C.: An alternate method for demonstration of erythrocytic aminotransferases on starch gels. Am. J. Hum. Genet. 33:561-563, 1981.

2771. Spritz, R. A.; Emanuel, B. S.; Chern, C. J.; Mellman, W. J.: Gene dosage effect: intraband mapping of human soluble glutamic oxaloacetic transaminase. Cytogenet. Cell Genet. 23: 149-156, 1979.

2772. Tomkins, D. J.; Gitelman, B. J.; Roberts, M. H.: Confirmation of a de novo duplication, dup(10)(q24-q26), by GOT1 gene dosage studies. Hum. Genet. 63: 369-373, 1983.

2773. Wang, C.-Y.; Huang, Y.-Q.; Shi, J.-O.; Marron, M. P.; Ruan, Q.-G.; Hawkins-Lee, B.; Ochoa, B.; She, J.-X.: Genetic homogeneity, high-resolution mapping, and mutation analysis of the urofacial (Ochoa) syndrome and exclusion of the glutamate oxaloacetate transaminase gene (GOT1) in the critical region as the disease gene. Am. J. Med. Genet. 84:454-459, 1999.

2774. Wurzinger, K. H.; Mohrenweiser, H. W.: Studies on the genetic and non-genetic (physiological) variation of human erythrocyte glutamicoxaloacetic transaminase. Ann. Hum. Genet. 46: 191-201, 1982.

2775. Abel, E. D.; Kaulbach, H. C.; Tian, R.; Hopkins, J. C. A.; Duffy, J.; Doetschman, T.; Minnemann, T.; Boers, M.-E.; Hadro, E.; Oberste-Berghaus, C.; Quist, W.; Lowell, B. B.; Ingwall, J. S.; Kahn, B. B.: Cardiachypertrophy with preserved contractile function after selective deletion of GLUT4 from the heart. J. Clin. Invest. 104: 1703-1714, 1999.

2776. Abel, E. D.; Peroni, O.; Kim, J. K.; Kim, Y.-B.; Boss, O.; Hadro, E.; Minnemann, T.; Shulman, G. I.; Kahn, B. B.: Adipose-selective targeting of the GLUT4 gene impairs insulin action in muscle and liver. Nature 409:729-733, 2001.

2777. Bell, G. I.; Kayano, T.; Buse, J. B.; Burant, C. F.; Takeda, J.; Lin, D.; Fukumoto, H.; Seino, S.: Molecular biology of mammalian glucose transporters. Diabetes Care 13: 198-208, 1990.

2778. Bell, G. I.; Murray, J. C.; Nakamura, Y.; Kayano, T.; Eddy, R. L.; Fan, Y.-S.; Byers, M. G.; Shows, T. B.: Polymorphic human insulin-responsive glucose-transporter gene on chromosome 17p13. Diabetes 38: 1072-1075, 1989.

2779. Birnbaum, M. J.: Identification of a novel gene encoding an insulin-responsive glucose transporter protein. Cell 57: 305-315, 1989.

2780. Chiang, S.-H.; Baumann, C. A.; Kanzaki, M.; Thurmond, D. C.; Watson, R. T.; Neudauer, C. L.; Macara, I. G.; Pessin, J. E.; Saltiel, A. R.: Insulin-stimulated GLUT4 translocation requires the CAP-dependent activation of TC10. Nature 410: 944-948, 2001.

2781. Garvey, W. T.; Maianu, L.; Zhu, J.-H.; Brechtel-Hook, G.; Wallace, P.; Baron, A. D.: Evidence for defects in the trafficking and translocation of GLUT4 glucose transporters in skeletal muscle as a cause of human insulin resistance. J. Clin. Invest. 101: 2377-2386, 1998.

2782. Ikemoto, S.; Thompson, K. S.; Itakura, H.; Lane, M. D.; Ezaki, O.: Expression of an insulin-responsive glucose transporter (GLUT4) minigene in transgenic mice: effect of exercise and role in glucose homeostasis. Proc. Nat. Acad. Sci. 92: 865-869, 1995.

2783. Katz, E. B.; Stenbit, A. E.; Hatton, K.; DePinho, R.; Charron, M. J.: Cardiac and adipose tissue abnormalities but not diabetes in mice deficient in GLUT4. Nature 377: 151-155, 1995.

2784. Kusari, J.; Verma, U. S.; Buse, J. B.; Henry, R. R.; Olefsky, J. M.: Analysis of the gene sequences of the insulin receptor and the insulin-sensitive glucose transporter (GLUT-4) in patients with common-type non-insulin-dependent diabetes mellitus. J. Clin. Invest. 88:1323-1330, 1991.

2785. Muraoka, A.; Sakura, H.; Kim, K.; Kishimoto, M.; Akanuma, Y.; Buse, J. B.; Yasuda, K.; Seino, S.; Bell, G. I.; Yazaki, Y.; Kasuga, M.; Kadowaki, T.: Polymorphism in exon 4a of the human GLUT4/muscle-fat facilitative glucose transporter gene detected by SSCP. Nucleic Acids Res. 19: 4313 only, 1991.

2786. Ribon, V.; Printen, J. A.; Hoffman, N. G.; Kay, B. K.; Saltiel, A. R.: A novel, multifunctional c-Cbl binding protein in insulin receptor signaling in 3T3-L1 adipocytes. Molec. Cell. Biol. 18:872-879, 1998.

2787. Zisman, A.; Peroni, O. D.; Abel, E. D.; Michael, M. D.; Mauvais-Jarvis, F.; Lowell, B. B.; Wojtaszewski, J. F. P.; Hirshman, M. F.; Virkamaki, A.; Goodyear, L. J.; Kahn, C. R.; Kahn, B. B.: Targeted disruption of the glucose transporter 4 selectively in muscle causes insulin resistance and glucose intolerance. Nature Med. 6: 924-928, 2000.

2788. Fishman, G. I.; Eddy, R. L.; Shows, T. B.; Rosenthal, L.; Leinwand, L. A.: The human connexin gene family of gap junction proteins: distinct chromosomal locations but similar structures. Genomics 10: 250-256, 1991.

2789. Fukushige, S.; Murotsu, T.; Matsubara, K.: Chromosomal assignment of human genes for gastrin, thyrotropin (TSH)-beta subunit and C-erb-2 by chromosome sorting combined with velocity sedimentation and southern hybridization. Biochem. Biophys. Res. Commun. 134: 477-483, 1986.

2790. Justice, M. J.; Gilbert, D. J.; Kinzler, K. W.; Vogelstein, B.; Buchberg, A. M.; Ceci, J. D.; Matsuda, Y.; Chapman, V. M.; Patriotis, C.; Makris, A.; Tsichlis, P. N.; Jenkins, N. A.; Copeland, N. G.: A molecular genetic linkage map of mouse chromosome 18 reveals extensive linkage conservation with human chromosomes 5 and 18. Genomics 13:1281-1288, 1992.

2791. Triantafilou, K.; Triantafilou, M.; Dedrick, R. L.: A CD14-independent LPS receptor cluster. Nature Immun. 2: 338-345, 2001.

2792. Lamaze, C.; Dujeancourt, A.; Baba, T.; Lo, C. G.; Benmerah, A.; Dautry-Varsat, A.: Interleukin 2 receptors and detergent-resistant membrane domains define a clathrin-independent endocytic pathway. Molec. Cell 7: 661-671, 2001.

2793. Eklund, L.; Piuhola, J.; Komulainen, J.; Sormunen, R.; Ongvarrasopone, C.; Fassler, R.; Muona, A.; Iives, M.; Ruskoaho, H.; Takala, T. E. S.; Pihlajaniemi, T.: Lack of type XV collagen causes a skeletal myopathy and cardiovascular defects in mice. Proc. Nat. Acad. Sci. 98:1194-1199, 2001.

2794. Hagg, P. M.; Hagg, P. O.; Peltonen, S.; Autio-Harmainen, H.; Pihlajaniemi, T.: Location of type XV collagen in human tissues and its accumulation in the interstitial matrix of the fibrotic kidney. Am. J. Path. 150:2075-2086, 1997.

2795. Hagg, P. M.; Horelli-Kuitunen, N.; Eklund, L.; Palotie, A.; Pihlajaniemi, T.: Cloning of mouse type XV collagen sequences and mapping of the corresponding gene to 4B1-3: comparison of mouse and human alpha-1(XV) collagen sequences indicates divergence in the number of small collagenous domains. Genomics 45: 31-41, 1997.

2796. Hagg, P. M.; Muona, A.; Lietard, J.; Kivirikko, S.; Pihlajaniemi, T.: Complete exon-intron organization of the human gene for the alpha-1 chain of type XV collagen (COL15A1) and comparison with the homologous Col18a1 gene. J. Biol. Chem. 273: 17824-17831, 1998.

2797. Huebner, K.; Cannizzaro, L. A.; Jabs, E. W.; Kivirikko, S.; Manzone, H.; Pihlajaniemi, T.; Myers, J. C.: Chromosomal assignment of a geneen coding a new collagen type (COL15A1) to 9q21-q22. Genomics 14:220-224, 1992.

2798. Kivirikko, S.; Heinamaki, P.; Rehn, M.; Honkanen, N.; Myers, J. C.; Pihlajaniemi, T.: Primary structure of the alpha-1 chain of human type XV collagen and exon-intron organization in the 3-prime region of the corresponding gene. J. Biol. Chem. 269: 4773-4779, 1994.

2799. Muragaki, Y.; Abe, N.; Ninomiya, Y.; Olsen, B. R.; Ooshima, A.: The human alpha-1(XV) collagen chain contains a large amino-terminal non-triple helical domain with a tandem repeat structure and homology to alpha-1(XVIII) collagen. J. Biol. Chem. 269: 4042-4046, 1994.

2800. Myers, J. C.; Dion, A. S.; Abraham, V.; Amenta, P. S.: Type XV collagen exhibits a widespread distribution in human tissues but a distinct localization in basement membrane zones. Cell Tissue Res. 286:493-505, 1996.

2801. Myers, J. C.; Kivirikko, S.; Gordon, M. K.; Dion, A. S.; Pihlajaniemi, T.: Identification of a previously unknown human collagen chain, alpha-1(XV), characterized by extensive interruptions in the triple-helical region. Proc. Nat. Acad. Sci. 89: 10144-10148, 1992.

2802. Ramchandran, R.; Dhanabal, M.; Volk, R.; Waterman, M. J. F.; Segal, M.; Lu, H.; Knebelmann, B.; Sukhatme, V. P.: Antiangiogenic activity of rest in, NC10 domain of human collagen XV: comparison to endostatin. Biochem. Biophys. Res. Commun. 255: 735-739, 1999.

2803. Rehn, M.; Hintikka, E.; Pihlajaniemi, T.: Primary structure of the alpha 1 chain of mouse type XVIII collagen, partial structure of the corresponding gene, and comparison of the alpha 1(XVIII) chain with its homologue, the alpha 1(XV) collagen chain. J. Biol. Chem. 269:13929-13935, 1994.

2804. Sasaki, T.; Larsson, H.; Tisi, D.; Claesson-Welsh, L.; Hohenester, E.; Timpl, R.: Endostatins derived from collagens XV and XVIII differ in structural and binding properties, tissue distribution and anti-angiogenic activity. J. Molec. Biol. 301: 1179-1190, 2000.

2805. Hulsebos, T. J. M.; Jenkins, N. A.; Gilbert, D. J.; Copeland, N. G.: The beta crystallin genes on human chromosome 22 define a new region of homology with mouse chromosome 5. Genomics 25: 574-576, 1995.

2806. Lampi, K. J.; Ma, Z.; Shih, M.; Shearer, T. R.; Smith, J. B.; Smith, D. L.; David, L. L.: Sequence analysis of beta-A3, beta-B3, and beta-A4 crystallins completes the identification of the major proteins in young human lens. J. Biol. Chem. 272: 2268-2275, 1997.

2807. van Rens, G.; Geurts van Kessel, A.; Bloemendal, H.: Localization of the beta-A4 crystallin (CRYBA4) gene on human chromosome 22 in the region q11.2-q13.1. (Abstract) Cytogenet. Cell Genet. 58: 2052 only, 1991.

2808. van Rens, G. L. M.; Geurts van Kessel, A. H. M.; Bloemendal, H.: Localization of the beta-A4-crystallin gene (CRYBA4) on human chromosome 22 in the region q11.2-q13.1. Cytogenet. Cell Genet. 61: 180-183, 1992.

2809. den Dunnen, J. T.; Jongbloed, R. J. E.; Geurts van Kessel, A. H. M.; Schoenmakers, J. G. G.: Human lens gamma-crystallin sequences are located in the p12-qter region of chromosome 2. Hum. Genet. 70:217-221, 1985.

2810. Fajans, S. S.; Bell, G. I.; Polonsky, K. S.: Molecular mechanisms and clinical pathophysiology of maturity-onset diabetes of the young. New Eng. J. Med. 345: 971-980, 2001.

2811. Wu, W. J.; Erickson, J. W.; Lin, R.; Cerione, R. A.: The gamma-subunit of the coatomer complex binds Cdc42 to mediate transformation. Nature 405:800-804, 2000.

2812. Wunderle, V. M.; Critcher, R.; Hastie, N.; Goodfellow, P. N.; Schedl, A.: Deletion of long-range regulatory elements upstream of SOX9 causes campomelic dysplasia. Proc. Nat. Acad. Sci. 95: 10649-10654, 1998.

2813. Young, I. D.; Zuccollo, J. M.; Maltby, E. L.; Broderick, N. J.: Campomelic dysplasia associated with a de novo 2q; 17q reciprocal translocation. J. Med. Genet. 29: 251-252, 1992.

2814. Bard, L. A.: Heterogeneity in Waardenburg's syndrome: report of a family with ocular albinism. Arch. Ophthal. 96: 1193-1198, 1978.

2815. Morell, R.; Spritz, R. A.; Ho, L.; Pierpont, J.; Guo, W.; Friedman, T. B.; Asher, J. H., Jr.: Apparent digenic inheritance of Waardenburg syndrome type 2 (WS2) and autosomal recessive ocular albinism (AROA). Hum. Molec. Genet. 6: 659-664, 1997.

2816. Smith, S. D.; Kelley, P. M.; Kenyon, J. B.; Hoover, D.: Tietz syndrome (hypopigmentation/deafness) caused by mutation of MITF. J. Med. Genet. 37: 446-448, 2000.

2817. Tietz, W.: A syndrome of deaf-mutism associated with albinism showing dominant autosomal inheritance. Am. J. Hum. Genet. 15: 259-264, 1963.

2818. Hsieh, C.-L.; Kumar, N. M.; Gilula, N. B.; Francke, U.: Distribution of genes for gap junction membrane channel proteins on human and mouse chromosomes. Somat. Cell Molec. Genet. 17: 191-200, 1991.

2819. DeStefano, A. L.; Baldwin, C. T.; Burzstyn, M.; Gavras, I.; Handy, D. E.; Joost, O.; Martel, T.; Nicolaou, M.; Schwartz, F.; Streeten, D. H. P.; Farrer, L. A.; Gavras, H.: Autosomal dominant orthostatichypotensive disorder maps to chromosome 18q. Am. J. Hum. Genet. 63:1425-1430, 1998.

2820. Barnett, T.; Zimmermann, W.: Workshop report: proposed nomenclature for the carcinoembryonic antigen (CEA) gene family. Tumor Biol. 11:59-63, 1990.

2821. Boulton, I. C.; Gray-Owen, S. D.: Neisserial binding to CEACAM1 arrests the activation and proliferation of CD4+ T lymphocytes. Nature Immun. 3: 229-236, 2002.

2822. Ergun, S.; Kilic, N.; Ziegeler, G.; Hansen, A.; Nollau, P.; Gotze, J.; Wurmbach, J.-H.; Horst, A.; Weil, J.; Fernando, M.; Wagener, C.: CEA-related cell adhesion molecule 1: a potent angiogenic factor and a major effector of vascular endothelial growth factor. Molec. Cell 5: 311-320, 2000.

2823. Hinoda, Y.; Neumaier, M.; Hefta, S. A.; Drzeniek, Z.; Wagener, C.; Shively, L.; Hefta, L. J. F.; Shively, J. E.; Paxton, R. J.: Molecular cloning of a cDNA coding biliary glycoprotein I: primary structure of a glycoprotein immunologically cross reactive with carcinoembryonic antigen. Proc. Nat. Acad. Sci. 85: 6959-6963, 1988.

2824. Neumaier, M.; Paululat, S.; Chan, A.; Matthaes, P.; Wagener, C.: Biliary glycoprotein, a potential human cell adhesion molecule, is down-regulated in colorectal carcinomas. Proc. Nat. Acad. Sci. 90:10744-10748, 1993.

2825. Poy, M. N.; Yang, Y.; Rezaei, K.; Fernstrom, M. A.; Lee, A. D.; Kido, Y.; Erickson, S. K.; Najjar, S. M.: CEACAM1 regulates insulin clearance in liver. Nature Genet. 30: 270-276, 2002.

2826. Robbins, J.; Robbins, P. F.; Kozak, C. A.; Callahan, R.: The mouse biliary glycoprotein gene (Bgp): partial nucleotide sequence, expression, and chromosomal assignment. Genomics 10: 583-587, 1991.

2827. Thompson, J. A.; Grunert, F.; Zimmermann, W.: Carcinoembryonic antigen gene family: molecular biology and clinical perspectives. J. Clin. Lab. Anal. 5: 344-366, 1991.

2828. Bierhuizen, M. F. A.; Mattei, M.-G.; Fukuda, M.: Expression of the developmental I antigen by a cloned human cDNA encoding a member of a beta-1,6-N-acetylglucosaminyltransferase gene family. Genes Dev. 7: 468-478, 1993.

2829. Lin-Chu, M.; Broadberry, R. E.; Okubo, Y.; Tanaka, M.: The i phenotype and congenital cataracts among Chinese in Taiwan (Letter) Transfusion 31:676-677, 1991.

2830. Ogata, H.; Okubo, Y.; Akabane, T.: Phenotype i associated with congenital cataract in Japanese. Transfusion 19: 166-168, 1979.

2831. Yeh, J.-C.; Ong, E.; Fukuda, M.: Molecular cloning and expression of a novel beta-1,6-N-acetylglucosaminyltransferase that forms core 2, core 4, and I branches. J. Biol. Chem. 274: 3215-3221, 1999.

2832. Yu, L.-C.; Twu, Y.-C.; Chang, C.-Y.; Lin, M.: Molecular basis of the adult i phenotype and the gene responsible for the expression of the human blood group I antigen. Blood 98: 3840-3845, 2001.

2833. Tommerup, N.; Schempp, W.; Meinecke, P.; Pedersen, S.; Bolund, L.; Brandt, C.; Goodpasture, C.; Guldberg, P.; Held, K.; Reinwein, H.; Saugstad, O. D.; Scherer, G.; Skjeldal, O.; Toder, R.; Westvik, J.; van der Hagen, C. B.; Wolf, U.: Assignment of an autosomal sexreversal locus (SRA1) and campomelic dysplasia (CMPD1) to 17q24.3-q25.1. Nature Genet. 4: 170-174, 1993.

2834. Azuma, N.; Nishina, S.; Yanagisawa, H.; Okuyama, T.; Yamada, M.: PAX6 missense mutation in isolated foveal hypoplasia. (Letter) Nature Genet. 13: 141-142, 1996.

2835. Curran, R. E.; Robb, R. M.: Isolated foveal hypoplasia. Arch. Ophthal. 94: 48-50, 1976.

2836. O'Donnell, F. E., Jr.; Pappas, H. R.: Autosomal dominant foveal hypoplasia and presenile cataracts: a new syndrome. Arch. Ophthal. 100:279-281, 1982.

2837. Angle, C. R.: Congenital bowing and angulation of the long bones. Pediatrics 13:257-268, 1954.

2838. Bain, A. D.; Barrett, H. S.: Congenital bowing of the long bones: report of a case. Arch. Dis. Child. 34: 516-524, 1959.

2839. Bell, D. M.; Leung, K. K. H.; Wheatley, S. C.; Ng, L. J.; Zhou, S.; Ling, K. W.; Sham, M. H.; Koopman, P.; Tam, P. P. L.; Cheah, K. S. E.: SOX9 directly regulates the type-II collagen gene. Nature Genet. 16: 174-178, 1997.

2840. Bi, W.; Huang, W.; Whitworth, D. J.; Deng, J. M.; Zhang, Z.; Behringer, R. R.; de Crombrugghe, B.: Haploinsufficiency of Sox9 results in defective cartilage primordia and premature skeletal mineralization. Proc. Nat. Acad. Sci. 98: 6698-6703, 2001.

2841. Bishop, C. E.; Whitworth, D. J.; Qin, Y.; Agoulnik, A. I.; Agoulnik, I. U.; Harrison, W. R.; Behringer, R. R.; Overbeek, P. A.: A transgenic insertion upstream of Sox9 is associated with dominant XX sex reversal in the mouse. Nature Genet. 26: 490-494, 2000.

2842. Caffey, J. P.: Prenatal bowing and thickening of tubular bones, with multiple cutaneous dimples in arms and legs: a congenital syndrome of mechanical origin. Am. J. Dis. Child. 74: 543-562, 1947.

2843. Cameron, F. J.; Hageman, R. M.; Cooke-Yarborough, C.; Kwok, C.; Goodwin, L. L.; Sillence, D. O.; Sinclair, A. H.: A novel germ line mutation in SOX9 causes familial campomelic dysplasia and sex reversal. Hum. Molec. Genet. 5: 1625-1630, 1996.

2844. Cameron, F. J.; Sinclair, A. H.: Mutations in SRY and SOX9: testis-determining genes. Hum. Mutat. 9: 388-395, 1997.

2845. Cooke, C. T.; Mulcahy, M. T.; Cullity, G. J.; Watson, M.; Sprague, P.: Campomelic dysplasia with sex reversal: morphological and cytogenetic studies of a case. Pathology 17: 526-529, 1985.

2846. Cremin, B. J.; Orsmond, G.; Beighton, P.: Autosomal recessive inheritance in camptomelic dwarfism. (Letter) Lancet I: 488-489, 1973.

2847. Dagna Bricarelli, F.; Fraccaro, M.; Lindsten, J.; Muller, U.; Baggio, P.; Carbone, L. D. L.; Hjerpe, A.; Lindgren, F.; Mayerova, A.; Ringertz, H.; Ritzen, E. M.; Rovetta, D. C.; Sicchero, C.; Wolf, U.: Sex-reversed XY females with campomelic dysplasia are H-Y negative. Hum. Genet. 57: 15-22, 1981.

2848. Ebensperger, C.; Jager, R. J.; Lattermann, U.; Dagna Bricarelli, F.; Keutel, J.; Lindsten, J.; Rehder, H.; Muller, U.; Wolf, U.: No evidence of mutations in four candidate genes for male sex determination/differentiation in sex-reversed XY females with campomelic dysplasia. Ann. Genet. 34:233-238, 1991.

2849. Fontaine, G.; Walbaum, R.; Farriaux, J. P.; Tilmont, P.; Peuzin, F.; Delecour, M.: Le conseil genetique dans la dysplasie campomelique (a propos de deux observations). J. Genet. Hum. 28: 267-279, 1980.

2850. Foster, J. W.; Dominguez-Steglich, M. A.; Guioli, S.; Kwok, C.; Weller, P. A.; Stevanovic, M.; Weissenbach, J.; Mansour, S.; Young, I. D.; Goodfellow, P. N.; Brook, J. D.; Schafer, A. J.: Campomelic dysplasia and autosomal sex reversal caused by mutations in an SRY-related gene. Nature 372: 525-530, 1994.

2851. Friedrich, U.; Schaefer, E.; Meinecke, P.: Campomelic dysplasia without overt campomelia. Clin. Dysmorph. 1: 172-178, 1992.

2852. Gasca, S.; Canizares, J.; de Santa Barbara, P.; Mejean, C.; Poulat, F.; Berta, P.; Boizet-Bonhoure, B.: A nuclear export signal within the high mobility group domain regulates the nucleocytoplasmic translocation of SOX9 during sexual determination. Proc. Nat. Acad. Sci. 99: 11199-11204, 2002.

2853. Glass, R. B. J.; Rosenbaum, K. N.: A campomelic campomelic dysplasia: further radiographic variations. Am. J. Med. Genet. 69: 29-32, 1997.

2854. Hall, B.; Spranger, J. W.: Campomelic dysplasia: further elucidation of a distinct entity. Am. J. Dis. Child. 134: 285-289, 1980.

2855. Hoefnagel, D.; Wurster-Hill, D. H.; Dupree, W. B.; Benirschke, K.; Fuld, G. L.: Camptomelic dwarfism associated with XY-gonadaldysgenesis and chromosome anomalies. Clin. Genet. 13: 489-499, 1978.

2856. Houston, C. S.; Opitz, J. M.; Spranger, J. W.; Macpherson, R. I.; Reed, M. H.; Gilbert, E. F.; Herrmann, J.; Schinzel, A.: The campomelic syndrome: review, report of 17 cases, and follow-up on the currently 17-year-old boy first reported by Maroteaux et al in 1971. Am. J. Med. Genet. 15: 3-28, 1983.

2857. Hovmoller, M. L.; Osuna, A.; Eklof, O.; Fredga, K.; Hjerpe, A.; Lindsten, J.; Ritzen, M.; Stanescu, V.; Svenningsen, N.: Camptomelicdwarfism. A genetically determined mesenchymal disorder combined with sex reversal. Hereditas 86: 51-62, 1977.

2858. Huang, W.; Chung, U.; Kronenberg, H. M.; de Crombrugghe, B.: The chondrogenic transcription factor Sox9 is a target of signaling by the parathyroid hormone-related peptide in the growth plate of endochondral bones. Proc. Nat. Acad. Sci. 98: 160-165, 2001.

2859. Kanai, Y.; Koopman, P.: Structural and functional characterization of the mouse Sox9 promoter: implications for campomelic dysplasia. Hum. Molec. Genet. 8: 691-696, 1999.

2860. Medema, R. H.; Kops, G. J. P. L.; Bos, J. L.; Burgering, B. M. T.: AFX-like fork head transcription factors mediate cell-cycle regulation by Ras and PKB through p27(kipl). Nature 404: 782-787, 2000.

2861. Bourgeois, C.; Robert, B.; Rebourcet, R.; Mondon, F.; Mignot, T.-M.; Duc-Goiran, P.; Ferre, F.: Endothelin-1 and ET(A) receptor expression in vascular smooth muscle cells from human placenta: a new ET(A) receptor messenger ribonucleic acid is generated by alternative splicing of exon 3. J. Clin. Endocr. Metab. 82: 3116-3123, 1997.

2862. Amato, F.; Warnes, G. M.; Kirby, C. A.; Norman, R. J.: Infertility caused by hCG autoantibody. J. Clin. Endocr. Metab. 87: 993-997, 2002.

2863. Naylor, S. L.; Chin, W. W.; Goodman, H. M.; Lalley, P. A.; Grzeschik, K.-H.; Sakaguchi, A. Y.: Chromosome assignment of the genes encoding the alpha and beta subunits of the glycoprotein hormones in man and mouse. Somat. Cell Genet. 9: 757-770, 1983.

2864. Mammarella, S.; Romano, F.; Di Valerio, A.; Creati, B.; Esposito, D. L.; Palmirotta, R.; Capani, F.; Vitullo, P.; Volpe, G.; Battista, P.; Della Loggia, F.; Mariani-Costantini, R.; Cama, A.: Interaction between the G1057D variant of IRS-2 and overweight in the pathogenesis of type 2 diabetes. Hum. Molec. Genet. 9: 2517-2521, 2000.

2865. Barker, P. E.; Shipp, M. A.; D'Adamio, L.; Masteller, E. L.; Reinherz, E. L.: The common acute lymphoblastic leukemia antigen gene maps to chromosomal region 3(q21-q27). J. Immun. 142: 283-287, 1989.

2866. D'Adamio, L.; Shipp, M. A.; Masteller, E. L.; Reinherz, E. L.: Organization of the gene encoding common acute lymphoblastic leukemia antigen (neutral endopeptidase 24.11): multiple miniexons and separate 5-prime untranslated regions. Proc. Nat. Acad. Sci. 86: 7103-7107, 1989.

2867. Debiec, H.; Guigonis, V.; Mougenot, B.; Decobert, F.; Haymann, J.-P.; Bensman, A.; Deschenes, G.; Ronco, P. M.: Antenatal membranous glomerulonephritis due to antineutral endopeptidase antibodies. New Eng. J. Med. 346: 2053-2060, 2002.

2868. Letarte, M.; Vera, S.; Tran, R.; Addis, J. B. L.; Onizuka, R. J.; Quackenbush, E. J.; Jongeneel, C. V.; McInnes, R. R.: Common acute lymphocytic leukemia antigen is identical to neutral endopeptidase. J. Exp. Med. 168: 1247-1253, 1988.

2869. Shipp, M. A.; Vijayaraghavan, J.; Schmidt, E. V.; Masteller, E. L.; D'Adamio, L.; Hersh, L. B.; Reinherz, E. L.: Common acute lymphoblastic leukemia antigen (CALLA) is active neutral endopeptidase 24.11 ('enkephalinase'): direct evidence by cDNA transfection analysis. Proc. Nat. Acad. Sci. 86:297-301, 1989.

2870. Tran-Paterson, R.; Willard, H. F.; Letarte, M.: The common acute lymphoblastic leukemia antigen (neutral endopeptidase—3.4.24.11) gene is located on human chromosome 3. Cancer Genet. Cytogenet. 42:129-134, 1989.

2871. Lahn, B. T.; Page, D. C.: Four evolutionary strata on the human X chromosome. Science 286: 964-967, 1999.

2872. Lee, F. A.; Issacs, H.; Strauss, J.: The 'camptomelic' syndrome. Short life-span dwarfism with respiratory distress, hypotonia, peculiarfacies, and multiple skeletal and cartilaginous deformities. Am. J. Dis. Child. 124: 485-496, 1972.

2873. Lynch, S. A.; Gaunt, M. L.; Minford, A. M. B.: Campomelic dysplasia: evidence of autosomal dominant inheritance. J. Med. Genet. 30: 683-686, 1993.

2874. Macpherson, R. I.; Skinner, S. A.; Donnenfeld, A. E.: A campomelic campomelic dysplasia. Pediat. Radiol. 20: 90-93, 1989.

2875. Mansour, S.; Hall, C. M.; Pembrey, M. E.; Young, I. D.: A clinical and genetic study of campomelic dysplasia. J. Med. Genet. 32: 415-420, 1995.

2876. Maraia, R.; Saal, H. M.; Wangsa, D.: A chromosome 17q de novoparacentric inversion in a patient with campomelic dysplasia; casereport and etiologic hypothesis. Clin. Genet. 39: 401-408, 1991.

2877. Maroteaux, P.; Spranger, J. W.; Opitz, J. M.; Kucera, J.; Lowry, R. B.; Schimke, R. N.; Kagan, S. M.: Le syndrome campomelique. Presse Med. 22: 1157-1162, 1971.

2878. Meyer, J.; Sudbeck, P.; Held, M.; Wagner, T.; Schmitz, M. L.; Bricarelli, F. D.; Eggermont, E.; Friedrich, U.; Haas, O. A.; Kobelt, A.; Leroy, J. G.; van Maldergem, L.; Michel, E.; Mitulla, B.; Pfeiffer, R. A.; Schinzel, A.; Schmidt, H.; Scherer, G.: Mutational analysis of the SOX9 gene in campomelic dysplasia and autosomal sex reversal: lack of genotype/phenotype correlations. Hum. Molec. Genet. 6: 91-98, 1997.

2879. Moedjono, S. J.; Crandall, B. F.; Sparkes, R. S.; Feldman, G. M.; Austin, G. E.; Perry, S.: The campomelic syndrome in a singleton and monozygotic twins. Clin. Genet. 18: 397-401, 1980.

2880. Moog, U.; Jansen, N. J. G.; Scherer, G.; Schrander-Stumpel, C. T. R. M.: A campomelic campomelic syndrome. Am. J. Med. Genet. 104:239-245, 2001.

2881. Morais da Silva, S.; Hacker, A.; Harley, V.; Goodfellow, P.; Swain, A.; Lovell-Badge, R.: Sox9 expression during gonadal development implies a conserved role for the gene in testis differentiation in mammals and birds. Nature Genet. 14: 62-68, 1996.

2882. Murakami, S.; Kan, M.; McKeehan, W. L.; de Crombrugghe, B.: Up-regulation of the chondrogenic Sox9 gene by fibroblast growth factors is mediated by the mitogen-activated protein kinase pathway. Proc. Nat. Acad. Sci. 97: 1113-1118, 2000.

2883. Ninomiya, S.; Isomura, M.; Narahara, K.; Seino, Y.; Nakamura, Y.: Isolation of a testis-specific cDNA on chromosome 17q from a region adjacent to the breakpoint of t(12;17) observed in a patient with acampomelic campomelic dysplasia and sex reversal. Hum. Molec. Genet. 5: 69-72, 1996.

2884. Ninomiya, S.; Yokoyama, Y.; Teraoka, M.; Mori, R.; Inoue, C.; Yamashita, S.; Tamai, H.; Funato, M.; Seino, Y.: A novel mutation (296 del G) of the SOX9 gene in a patient with campomelic syndrome and sex reversal. Clin. Genet. 58: 224-227, 2000.

2885. Olney, P. N.; Kean, L. S.; Graham, D.; Elsas, L. J.; May, K. M.: Campomelic syndrome and deletion of SOX9. Am. J. Med. Genet. 84:20-24, 1999.

2886. Ozkilic, A.; Seven, M.; Yuksel, A.: A case of acampomelic campomelicdysplasia. Genet. Counsel. 13: 23-28, 2002.

2887. Patel, M.; Dorman, K. S.; Zhang, Y.-H.; Huang, B.-L.; Arnold, A. P.; Sinsheimer, J. S.; Vilain, E.; McCabe, E. R. B.: Primate DAX1, SRY, and SOX9: evolutionary stratification of sex-determination pathway. Am. J. Hum. Genet. 68: 275-280, 2001.

2888. Pfeifer, D.; Kist, R.; Dewar, K.; Devon, K.; Lander, E. S.; Birren, B.; Korniszewski, L.; Back, E.; Scherer, G.: Campomelic dysplasia translocation breakpoints are scattered over 1 Mb proximal to SOX9: evidence for an extended control region. Am. J. Hum. Genet. 65:111-124, 1999.

2889. Puck, S. M.; Haseltine, F. P.; Francke, U.: Absence of H-Y antigen in an XY female with campomelic dysplasia. Hum. Genet. 57: 23-27, 1981.

2890. Rimoin, D. L.: Personal Communication. Torrance, Calif. Aug. 12, 1976.

2891. Rodriguez, J. I.: Vascular anomalies in campomelic syndrome. Am. J. Med. Genet. 46: 185-192, 1993.

2892. Savarirayan, R.; Bankier, A.: A campomelic campomelic dysplasia with de novo 5q;17q reciprocal translocation and severe phenotype. J. Med. Genet. 35: 597-599, 1998.

2893. Schimke, R. N.: XY sex-reversed campomelia-possibly an X-linked disorder? (Letter) Clin. Genet. 16: 62-63, 1979.

2894. Shafai, T.; Schwartz, L.: Camptomelic syndrome in siblings. J. Pediat. 89: 512-513, 1976.

2895. Spranger, J.: Advances in bone dysplasias. (Abstract) Sixth Int. Cong. Hum. Genet. Jerusalem, 1981.

2896. Stuve, A.; Wiedemann, H.-R.: Congenital bowing of the long bones in two sisters. (Letter) Lancet I: 495, 1971.

2897. Sudbeck, P.; Schmitz, M. L.; Baeuerle, P. A.; Scherer, G.: Sex reversal by loss of the C-terminal transactivation domain of human SOX9. Nature Genet. 13: 230-232, 1996.

2898. Thong, M.-K.; Scherer, G.; Kozlowski, K.; Haan, E.; Morris, L.: A campomelic campomelic dysplasia with SOX9 mutation. Am. J. Med. Genet. 93: 421-425, 2000.

2899. Thurmon, T. F.; De Fraites, E. B.; Anderson, E. E.: Familialcampomelic dwarfism. J. Pediat. 83: 841-843, 1973.

2900. Vidal, V. P. I.; Chaboissier, M.-C.; de Rooij, D. G.; Schedl, A.: Sox9 induces testis development in XX transgenic mice. Nature Genet. 28: 216-217, 2001.

2901. Wagner, T.; Wirth, J.; Meyer, J.; Zabel, B.; Held, M.; Zimmer, J.; Pasantes, J.; Dagna Bricarelli, F.; Keutel, J.; Hustert, E.; Wolf, U.; Tommerup, N.; Schempp, W.; Scherer, G.: Autosomal sex reversal and campomelic dysplasia are caused by mutations in and around the SRY-related gene SOX9. Cell 79: 1111-1120, 1994.

2902. Weller, S. D. V.: Hypophosphatasia with congenital dimples. Proc. Roy. Soc. Med. 52: 637, 1959.

2903. Wirth, J.; Wagner, T.; Meyer, J.; Pfeiffer, R. A.; Tietze, H.-U.; Schempp, W.; Scherer, G.: Translocation breakpoints in three patients with campomelic dysplasia and autosomal sex reversal map more than 130 kb from SOX9. Hum. Genet. 97: 186-193, 1996.

2904. Wright, E.; Hargrave, M. R.; Christiansen, J.; Cooper, L.; Kun, J.; Evans, T.; Gangadharan, U.; Greenfield, A.; Koopman, P.: The Sry-related gene Sox9 is expressed during chondrogenesis in mouse embryos. Nature Genet. 9: 15-20, 1995.

2905. Gillessen-Kaesbach, G.; Demuth, S.; Thiele, H.; Theile, U.; Lich, C.; Horsthemke, B.: A previously unrecognised phenotype characterised by obesity, muscular hypotonia, and ability to speak in patients with Angelman syndrome caused by an imprinting defect. Europ. J. Hum. Genet. 7: 638-644, 1999.

2906. Acosta, J.; Hettinga, J.; Fluckiger, R.; Krumrei, N.; Goldfine, A.; Angarita, L.; Halperin, J.: Molecular basis for a link between complement and the vascular complications of diabetes. Proc. Nat. Acad. Sci. 97: 5450-5455, 2000.

2907. Bickmore, W. A.; Longbottom, D.; Oghene, K.; Fletcher, J. M.; van Heyningen, V.: Colocalization of the human CD59 gene to 11p13 with the MIC11 cell surface antigen. Genomics 17: 129-135, 1993.

2908. Davies, A.; Simmons, D. L.; Hale, G.; Harrison, R. A.; Tighe, H.; Lachmann, P. J.; Waldmann, H.: CD59, an LY-6-like protein expressed in human lymphoid cells, regulates the action of the complement membrane attack complex on homologous cells. J. Exp. Med. 170: 637-654, 1989.

2909. Forsberg, U. H.; Bazil, V.; Stefanova, I.; Schroder, J.: Gene for human CD59 (likely Ly-6 homologue) is located on the short arm of chromosome 11. Immunogenetics 30: 188-193, 1989.

2910. Harada, R.; Okada, N.; Fujita, T.; Okada, H.: Purification of 1F5 antigen that prevents complement attack on homologous cell membranes. J. Immun. 144: 1823-1828, 1990.

2911. Heckl-Ostreicher, B.; Ragg, S.; Drechsler, M.; Scherthan, H.; Royer-Pokora, B.: Localization of the human CD59 gene by fluorescence in situ hybridization and pulsed-field gel electrophoresis. Cytogenet. Cell Genet. 63:144-146, 1993.

2912. Holt, D. S.; Botto, M.; Bygrave, A. E.; Hanna, S. M.; Walport, M. J.; Morgan, B. P.: Targeted deletion of the CD59 gene causes spontaneous intravascular hemolysis and hemoglobinuria. Blood 98: 442-449, 2001.

2913. Holt, D. S.; Powell, M. B.; Rushmere, N. K.; Morgan, B. P.: Genomic structure and chromosome location of the gene encoding mouse CD59. Cytogenet. Cell Genet. 89: 264-267, 2000.

2914. Huppi, K.; Duncan, R.; Potter, M.: Myc-1 is centromeric to the linkage group Ly-6-Sis-Gdc-1 on mouse chromosome 15. Immunogenetics 27:215-219, 1988.

2915. Kamiura, S.; Nolan, C. M.; Meruelo, D.: Long-range physical map of the Ly-6 complex: mapping the Ly-6 multigene family by field-inversion and two-dimensional gel electrophoresis. Genomics 12: 89-105, 1992.

2916. Low, M. G.; Saltiel, A. R.: Structural and functional roles of glycosyl-phosphatidylinositol in membranes. Science 239: 268-275, 1988.

2917. Mahoney, J. F.; Urakaze, M.; Hall, S.; DeGasperi, R.; Chang, H.-M.; Sugiyama, E.; Warren, C. D.; Borowitz, M.; Nicholson-Weller, A.; Rosse, W. F.; Yeh, E. T. H.: Defective glycosylphosphatidyl inositol anchor synthesis in paroxysmal nocturnal hemoglobinuria granulocytes. Blood 79:1400-1403, 1992.

2918. Mao, M.; Yu, M.; Tong, J.-H.; Ye, J.; Zhu, J.; Huang, Q.-H.; Fu, G.; Yu, L.; Zhao, S.-Y.; Waxman, S.; Lanotte, M.; Wang, Z.-Y.; Tan, J.-Z.; Chan, S.-J.; Chen, Z.: RIG-E, a human homolog of the murine Ly-6 family, is induced by retinoic acid during the differentiation of acute promyelocytic leukemia cell. Proc. Nat. Acad. Sci. 93:5910-5914, 1996.

2919. Meri, S.; Morgan, B. P.; Davies, A.; Daniels, R. H.; Olavesen, M. G.; Waldmann, H.; Lachmann, P. J.: Human protect in (CD59), an 18,000 MW complement lysis restricting factor, inhibits C5b-8 catalysed insertion of C9 into lipid bilayers. Immunology 71: 1-9, 1990.

2920. Meri, S.; Morgan, B. P.; Wing, M.; Jones, J.; Davies, A.; Podack, E.; Lachmann, P. J.: Human protectin (CD59), an 18-20-kD homologous complement restriction factor, does not restrict perforin-mediated lysis. J. Exp. Med. 172: 367-370, 1990.

2921. Motoyama, N.; Okada, N.; Yamashina, M.; Okada, H.: Paroxysmal nocturnal hemoglobinuria due to hereditary nucleotide deletion in the HRF20 (CD59) gene. Europ. J. Immun. 22: 2669-2673, 1992.

2922. Okada, N.; Harada, R.; Fujita, T.; Okada, H.: A novel membrane glycoprotein capable of inhibiting membrane attack by homologous complement. Int. Immun. 1: 205-208, 1989.

2923. Szpirer, C.; Riviere, M.; Cortese, R.; Nakamura, T.; Islam, M. Q.; Levan, G.; Szpirer, J.: Chromosomal localization in man and rat of the genes encoding the liver-enriched transcription factors C/EBP, DBP, and HNF1/LFB-1 (CEBP, DBP, and transcription factor 1, TCF1, respectively) and of the hepatocyte growth factor/scatter factor gene (HGF). Genomics 13: 293-300, 1992.

2924. Boorstein, W. R.; Vamvakopoulos, N. C.; Fiddes, J. C.: Human chorionicgon adotropin beta-subunit is encoded by at least eight genes arranged in tandem and inverted pairs. Nature 300: 419-422, 1982.

2925. Fiddes, J. C.; Goodman, H. M.: The cDNA for the beta-subunit ofhuman chorionic gonadotropin suggests evolution of a gene by read through into the 3-prime-untranslated region. Nature 286: 684-687, 1980.

2926. Graham, M. Y.; Otani, T.; Boime, I.; Olson, M. V.; Carle, G. F.; Chaplin, D. D.: Cosmid mapping of the human chorionic gonadotropin beta subunit genes by field-inversion gel electrophoresis. Nucleic Acids Res. 15: 4437-4448, 1987.

2927. Julier, C.; Weil, D.; Couillin, P.; Cote, J. C.; Boue, A.; Thririon, J. P.; Kaplan, J. C.; Junien, C.: Confirmation of the assignment of the genes coding for human chorionic gonadotropin beta subunit to chromosome 19. (Abstract) Cytogenet. Cell Genet. 37: 501-502, 1984.

2928. Julier, C.; Weil, D.; Couillin, P.; Cote, J. C.; Van Cong, N.; Foubert, C.; Boue, A.; Thirion, J. P.; Kaplan, J. C.; Junien, C.: The beta chorionic gonadotropin-beta luteinizing gene cluster maps to human chromosome 19. Hum. Genet. 67: 174-177, 1984.

2929. Lunardi-Iskander, Y.; Bryant, J. L.; Zeman, R. A.; Lam, V. H.; Samaniego, F.; Besnier, J. M.; Hermans, P.; Thierry, A. R.; Gill, P.; Gallo, R. C.: Tumorigenesis and metastasis of neoplastic Kaposi'ssarcoma cell line in immunodeficient mice blocked by a human pregnancy hormone. Nature 375: 64-68, 1995.

2930. Policastro, P.; Ovitt, C. E.; Hoshina, M.; Fukuoka, H.; Boothby, M. R.; Biome, I.: The beta-subunit of human chorionic gonadotropin is encoded by multiple genes. J. Biol. Chem. 258: 11492-11499, 1983.

2931. Policastro, P. F.; Daniels-McQueen, S.; Carle, G.; Boime, I.: A map of the hCG-beta-LH-beta gene cluster. J. Biol. Chem. 261:5907-5916, 1986.

2932. Talmadge, K.; Vamvakopoulos, N. C.; Fiddes, J. C.: Evolution of the genes for the beta subunits of human chorionic gonadotropin and luteinizing hormone. Nature 307: 37-40, 1984.

2933. Warburton, D.; Gersen, S.; Yu, M.-T.; Jackson, C.; Handelin, B.; Housman, D.: Monochromosomal rodent-human hybrids from microcell fusion of human lymphoblastoid cells containing an inserted dominant selectable marker. Genomics 6: 358-366, 1990.

2934. Seri, M.; Celli, I.; Betsos, N.; Claudiani, F.; Camera, G.; Romeo, G.: A cys634gly substitution of the RET proto-oncogene in a family with recurrence of multiple endocrine neoplasia type 2A and cutaneous lichen amyloidosis. Clin. Genet. 51: 86-90, 1997.

2935. Hofstra, R. M. W.; Sijmons, R. H.; Stelwagen, T.; Stulp, R. P.; Kousseff, B. G.; Lips, C. J. M.; Steijlen, P. M.; Van Voorst Vader, P. C.; Buys, C. H. C. M.: RET mutation screening in familial cutaneous lichen amyloidosis and in skin amyloidosis associated with multiple endocrine neoplasia. J. Invest. Derm. 107: 215-218, 1996.

2936. Fantes, J. A.; Bickmore, W. A.; Fletcher, J. M.; Ballesta, F.; Hanson, I. M.; van Heyningen, V.: Submicroscopic deletions at the WAGR locus, revealed by nonradioactive in situ hybridization. Am. J. Hum. Genet. 51: 1286-1294, 1992.

2937. Glaser, T.; Jepeal, L.; Edwards, J. G.; Young, S. R.; Favor, J.; Maas, R. L.: PAX6 gene dosage effect in a family with congenital cataracts, aniridia, anophthalmia and central nervous system defects. Nature Genet. 7: 463-471, 1994.

2938. Glaser, T.; Lane, J.; Housman, D.: A mouse model of the aniridia-Wilmstumor deletion syndrome. Science 250: 823-827, 1990.

2939. Gronskov, K.; Olsen, J. H.; Sand, A.; Pedersen, W.; Carlsen, N.; Jylling, A. M. B.; Lyngbye, T.; Brondum-Nielsen, K.; Rosenberg, T.: Population-based risk estimates of Wilms tumor in sporadic aniridia: a comprehensive mutation screening procedure of PAX6 identifies 80% of mutations in aniridia. Hum. Genet. 109: 11-18, 2001.

2940. Hanson, I. M.; Seawright, A.; Hardman, K.; Hodgson, S.; Zaletayev, D.; Fekete, G.; van Heyningen, V.: PAX6 mutations in aniridia. Hum. Molec. Genet. 2: 915-920, 1993.

2941. Hill, R. E.; Favor, J.; Hogan, B. L. M.; Ton, C. C. T.; Saunders, G. F.; Hanson, I. M.; Prosser, J.; Jordan, T.; Hastie, N. D.; van Heyningen, V.: Mouse small eye results from mutations in a paired-like homeobox-containing gene. Nature 354: 522-525, 1991.

2942. Jordan, T.; Hanson, I.; Zaletayev, D.; Hodgson, S.; Prosser, J.; Seawright, A.; Hastie, N.; van Heyningen, V.: The human PAX6 gene is mutated in two patients with aniridia. Nature Genet. 1: 328-332, 1992.

2943. Karpen, G. H.: Position effect variegation and the new biology of heterochromatin. Curr. Opin. Genet. Dev. 4: 281-291, 1994.

2944. Lyon, M. F.: Personal Communication. Harwell, England Jun. 9, 1988.

2945. Martha, A.; Strong, L. C.; Ferrell, R. E.; Saunders, G. F.: Three novel aniridia mutations in the human PAX6 gene. Hum. Mutat. 6:44-49, 1995.

2946. Matsuo, T.; Osumi-Yamashita, N.; Noji, S.; Ohuchi, H.; Koyama, E.; Myokai, F.; Matsuo, N.; Taniguchi, S.; Doi, H.; Iseki, S.; Ninomiya, Y.; Fujiwara, M.; Watanabe, T.; Eto, K.: A mutation in the Pax-6 gene in rat small eye is associated with impaired migration of midbrain crest cells. Nature Genet. 3: 299-304, 1993.

2947. Oliver, M. D.; Dotan, S. A.; Chemke, J.; Abraham, F. A.: Isolated foveal hypoplasia. Brit. J. Ophthal. 71: 926-930, 1987.

2948. Prosser, J.; van Heyningen, V.: PAX6 mutations reviewed. Hum. Mutat. 11: 93-108, 1998.

2949. Quiring, R.; Walldorf, U.; Kloter, U.; Gehring, W. J.: Homology of the eyeless gene of *Drosophila* to the small eye gene in mice and aniridia in humans. Science 265: 785-789, 1994.

2950. Salvini-Plawen, L.; Mayr, E.: On the evolution of photoreceptors and eyes. In: Hecht, M. K.; Steere, W.; Wallace, B.: Evolutionary Biology. New York: Plenum Pub. (pub.) 10: 1977. Pp. 207-263.

2951. Schedl, A.; Ross, A.; Lee, M.; Engelkamp, D.; Rashbass, P.; van Heyningen, V.; Hastie, N. D.: Influence of PAX6 gene dosage on development: overexpression causes severe eye abnormalities. Cell 86: 71-82, 1996.

2952. Stone, D. L.; Kenyon, K. R.; Green, W. R.; Ryan, S. J.: Congenital central corneal leukoma (Peters' anomaly). Am. J. Ophthal. 81: 173-193, 1976.

2953. van der Meer-deJong, R.; Dickinson, M. E.; Woychik, R. P.; Stubbs, L.; Hetherington, C.; Hogan, B. L. M.: Location of the gene involving the small eye mutation on mouse chromosome 2 suggests homology with human aniridia 2 (AN2). Genomics 7: 270-275, 1990.

2954. Cowan, C. A.; Yokoyama, N.; Bianchi, L. M.; Henkemeyer, M.; Fritzsch, B.: EphB2 guides axons at the midline and is necessary for normal vestibular function. Neuron 26: 417-430, 2000.

2955. Ton, C. C. T.; Hirvonen, H.; Miwa, H.; Weil, M. M.; Monaghan, P.; Jordan, T.; van Heyningen, V.; Hastie, N. D.; Meijers-Heijboer, H.; Drechsler, M.; Royer-Pokora, B.; Collins, F.; Swaroop, A.; Strong, L. C.; Saunders, G. F.: Positional cloning and characterization of a paired box- and homeobox-containing gene from the aniridia region. Cell 67:1059-1074, 1991.

2956. Schmickel, R. D.: Contiguous gene syndromes: a component of recognizable syndromes. J. Pediat. 109: 231-241, 1986.

2957. Valent, A.; Danglot, G.; Bernheim, A.: Mapping of the tyrosine kinase receptors trkA (NTRK1), trkB (NTRK2) and trkC (NTRK3) to human chromosomes 1q22, 9q22 and 15q25 by fluorescence in situ hybridization. Europ. J. Hum. Genet. 5: 102-104, 1997.

2958. Day, I. N. M.; Hinks, L. J.; Thompson, R. J.: The structure of the gene encoding protein gene product 9.5 (PGP9.5), a neuron-specific ubiquitin C-terminal hydrolase. Biochem. J. 268: 521-524, 1990.

2959. Day, I. N. M.; Thompson, R. J.: Molecular cloning of cDNA coding for human PGP 9.5 protein: a novel cytoplasmic marker for neurones and neuroendocrine cells. FEBS Lett. 210: 157-160, 1987.

2960. Doran, J. F.; Jackson, P.; Kynoch, P.; Thompson, R. J.: Isolation of PGP 9.5, a new human neurone-specific protein detected by high-resolution two-dimensional electrophoresis. J. Neurochem. 40: 1542-1547, 1983.

2961. Edwards, Y. H.; Fox, M. F.; Povey, S.; Hinks, L. J.; Day, I. N. M.; Thompson, R. J.: The gene for human neuron specific ubiquitin C-terminal hydrolase maps to chromosome 4p14. (Abstract) Cytogenet. Cell Genet. 58: 1886-1887, 1991.

2962. Kurihara, L. J.; Kikuchi, T.; Wada, K.; Tilghman, S. M.: Loss of Uch-L1 and Uch-L3 leads to neurodegeneration, posterior paralysis and dysphagia. Hum. Molec. Genet. 10: 1963-1970, 2001.

2963. Kurihara, L. J.; Semenova, E.; Levorse, J. M.; Tilghman, S. M.: Expression and functional analysis of Uch-L3 during mouse development. Molec. Cell. Biol. 20: 2498-2504, 2000.

2964. Leroy, E.; Boyer, R.; Auburger, G.; Leube, B.; Ulm, G.; Mezey, E.; Harta, G.; Brownstein, M. J.; Jonnalagada, S.; Chernova, T.; Dehejia, A.; Lavedan, C.; Gasser, T.; Steinbach, P. J.; Wilkinson, K. D.; Polymeropoulos, M. H.: The ubiquitin pathway in Parkinson's disease. (Letter) Nature 395:451-452, 1998.

2965. Lincoln, S.; Vaughan, J.; Wood, N.; Baker, M.; Adamson, J.; Gwinn-Hardy, K.; Lynch, T.; Hardy, J.; Farrer, M.: Low frequency of pathogenic mutations in the ubiquitin carboxy-terminal hydrolase gene in familial Parkinson's disease. Neuroreport 10: 427-429, 1999.

2966. MacDonald, M. E.: Gadzooks! Nature Genet. 23: 10-11, 1999.

2967. Saigoh, K.; Wang, Y.-L.; Suh, J.-G.; Yamanishi, T.; Sakai, Y.; Kiyosawa, H.; Harada, T.; Ichihara, N.; Wakana, S.; Kikuchi, T.; Wada, K.: Intragenic deletion in the gene encoding ubiquitin carboxy-terminal hydrolase in gad mice. Nature Genet. 23: 47-51, 1999.

2968. Suh, J. G.; Yamanishi, T.; Matsui, K.; Tanaka, K.; Wada, K.: Mapping of the gracile axonal dystrophy (gad) gene to a region between D5Mit197 and D5Mit113 on proximal mouse chromosome 5. Genomics 27:549-551, 1995.

2969. Wilkinson, K. D.; Lee, K. M.; Deshpande, S.; Duerksen-Hughes, P.; Boss, J. M.; Pohl, J.: The neuron-specific protein PGP 9.5 is a ubiquitin carboxyl-terminal hydrolase. Science 246: 670-672, 1989.

2970. Yamazaki, K.; Wakasugi, N.; Tomita, T.; Kikuchi, T.; Mukoyama, M.; Ando, K.: Gracile axonal dystrophy (GAD), a new neurological mutant in the mouse. Proc. Soc. Exp. Biol. Med. 187: 209-215, 1988.

2971. Morii, K.; Tanaka, R.; Takahashi, Y.; Minoshima, S.; Fukuyama, R.; Shimizu, N.; Kuwano, R.: Structure and chromosome assignment of human S100 alpha and beta subunit genes. Biochem. Biophys. Res. Commun. 175: 185-191, 1991.

2972. Ip, N. Y.; Stitt, T. N.; Tapley, P.; Klein, R.; Glass, D. J.; Fandl, J.; Greene, L. A.; Barbacid, M.; Yancopoulos, G. D.: Similarities and differences in the way neurotrophins interact with the Trk receptors in neuronal and nonneuronal cells. Neuron 10: 137-149, 1993.

2973. Bonnefont, J.-P.; Chretien, D.; Rustin, P.; Robinson, B.; Vassault, A.; Aupetit, J.; Charpentier, C.; Rabier, D.; Saudubray, J.-M.; Munnich, A.: Alpha-ketoglutarate dehydrogenase deficiency presenting as congenital lactic acidosis. J. Pediat. 121: 255-258, 1992.

2974. Guffon, N.; Lopez-Mediavilla, C.; Dumoulin, R.; Mousson, B.; Godinot, C.; Carrier, H.; Collombet, J. M.; Divry, P.; Mathieu, M.; Guibaud, P.: 2-Ketoglutarate dehydrogenase deficiency, a rare cause of primary hyperlactataemia: report of a new case. J. Inherit. Metab. Dis. 16:821-830, 1993.

2975. Kohlschutter, A.; Behbehani, A.; Langenbeck, U.; Albani, M.; Heidemann, P.; Hoffmann, G.; Kleineke, J.; Lehnert, W.; Wendel, U.: A familial progressive neurodegenerative disease with 2-oxoglutaric acid uria. Europ. J. Pediat. 138: 32-37, 1982.

2976. Koike, K.: The gene encoding human 2-oxoglutarate dehydrogenase: structural organization and mapping to chromosome 7p13-p14. Gene 159:261-266, 1995.

2977. Koike, K.; Urata, Y.; Goto, S.: Cloning and nucleotide sequence of the cDNA encoding human 2-oxoglutarate dehydrogenase (lipoamide). Proc. Nat. Acad. Sci. 89: 1963-1967, 1992.

2978. Szabo, P.; Cai, X.; Ali, G.; Blass, J. P.: Localization of the gene (OGDH) coding for the Elk component of the alpha-ketoglutarate dehydrogenase complex to chromosome 7p13-p11.2. Genomics 20: 324-326, 1994.

2979. Ono, H.; Kuno, Y.; Tanaka, H.; Yamashina, M.; Tsuyoshi, T.; Kondo, N.; Orii, T.: A case of paroxysmal nocturnal hemoglobinuria without deficiency of decay-accelerating factor on erythrocytes. Blood 75:1746-1747, 1990.

2980. Petranka, J. G.; Fleenor, D. E.; Sykes, K.; Kaufman, R. E.; Rosse, W. F.: Structure of the CD59-encoding gene: further evidence of a relationship to murine lymphocyte antigen Ly-6 protein. Proc. Nat. Acad. Sci. 89: 7876-7879, 1992.

2981. Rosse, W. F.: Personal Communication. Durham, N.C. Jun. 3, 1993.

2982. Rosse, W. F.; Parker, C. J.: Paroxysmal nocturnal hemoglobinuria. Clin. Haemat. 14: 105-125, 1985.

2983. Rother, R. P.; Rollins, S. A.; Mennone, J.; Chodera, A.; Fidel, S. A.; Bessler, M.; Hillmen, P.; Squinto, S. P.: Expression of recombinant transmembrane CD59 in paroxysmal nocturnal hemoglobinuria B cells confers resistance to human complement. Blood 84: 2604-2611, 1994.

2984. Tone, M.; Walsh, L. A.; Waldmann, H.: Gene structure of human CD59 and demonstration that discrete mRNAs are generated by alternative polyadenylation. J. Molec. Biol. 227: 971-976, 1992.

2985. Walsh, L. A.; Tone, M.; Thiru, S.; Waldmann, H.: The CD59 antigen—a multifunctional molecule. Tissue Antigens 40: 213-220, 1992.

2986. Yamashina, M.; Ueda, E.; Kinoshita, T.; Takami, T.; Ojima, A.; Ono, H.; Tanaka, H.; Kondo, N.; Orii, T.; Okada, N.; Okada, H.; Inoue, K.; Kitani, T.: Inherited complete deficiency of 20-kilodalton homologous restriction factor (CD59) as a cause of paroxysmal nocturnal hemoglobinuria. New Eng. J. Med. 323: 1184-1189, 1990.

2987. Loughney, K.; Martins, T. J.; Harris, E. A. S.; Sadhu, K.; Hicks, J. B.; Sonnenburg, W. K.; Beavo, J. A.; Ferguson, K.: Isolation and characterization of cDNAs corresponding to two human calcium, calmodulin-regulated, 3-prime, 5-prime-cyclic nucleotide phosphodiesterases. J. Biol. Chem. 271:796-806, 1996.

2988. Wilson, D. E.; McKenna, L.: Assignment of the human gene for phosphodiesterase 1A to chromosome 4. (Abstract) Am. J. Hum. Genet. 43: A162 only, 1988.

2989. Gallango, M. L.; Muller, A.; Suinaga, R.: Biochemical characterization of a red cell UMP kinase variant found in the Warao Indians of Venezuela. Biochem. Genet. 16: 1085-1093, 1978.

2990. Gallango, M. L.; Suinaga, R.: Uridine monophosphate kinase polymorphism in two Venezuelan populations. Am. J. Hum. Genet. 30: 215-218, 1978.

2991. Giblett, E. R.; Anderson, J. E.; Chen, S.-H.; Teng, Y.-S.; Cohen, F.: Uridine monophosphate kinase: a new genetic polymorphism with possible clinical implications. Am. J. Hum. Genet. 26: 627-635, 1974.

2992. Giblett, E. R.; Anderson, J. E.; Lewis, M.; Kaita, H.: A new polymorphic enzyme, uridine monophosphate kinase: gene frequencies and a linkage analysis. Birth Defects Orig. Art. Ser. 11(3): 159-161, 1975. Note: Alternate: Cytogenet. Cell Genet. 14: 329-331, 1975.

2993. Medrano, L.; Green, H.: A uridine kinase deficient mutant of 3T3 and a selective method for cells containing the enzyme. Cell 1:23-26, 1974.

2994. Petersen, G. M.; Silimperi, D. R.; Scott, E. M.; Hall, D. B.; Rotter, J. I.; Ward, J. I.: Uridine monophosphate kinase 3: a genetic marker for susceptibility to *Haemophilus influenzae* type B disease. Lancet II:417-418, 1985.

2995. Ranzani, G.; Bertolotti, E.; Santachiara-Benerecetti, A. S.: The polymorphism of the red cell uridine monophosphate kinase in two samples of the Italian population. Hum. Hered. 27: 332-335, 1977.

2996. Ruddle, F. H.; Creagan, R. P.: Parasexual approaches to the genetics of man. Ann. Rev. Genet. 9: 407-486, 1975.

2997. Satlin, A.; Kucherlapati, R. S.; Ruddle, F. H.: Assignment of the gene for human uridine monophosphate kinase to chromosome 1 using somatic cell hybrid clone panels. Cytogenet. Cell Genet. 15: 146-152, 1975.

2998. Xiong, J.-P.; Stehle, T.; Diefenbach, B.; Zhang, R.; Dunker, R.; Scott, D. L.; Joachimiak, A.; Goodman, S. L.; Arnaout, M. A.: Crystal structure of the extracellular segment of integrin alpha-V-beta-3. Science 294:339-345, 2001.

2999. Xiong, J.-P.; Stehle, T.; Zhang, R.; Joachimiak, A.; Frech, M.; Goodman, S. L.; Arnaout, M. A.: Crystal structure of the extracellular segment of integrin alpha-V-beta-3 in complex with an Arg-Gly-Aspligand. Science 296: 151-155, 2002.

3000. Disteche, C. M.; Plowman, G. D.; Gronwald, R. G. K.; Kelly, J.; Bowen-Pope, D.; Adler, D. A.; Murray, J. C.: Mapping of the amphiregulin and the platelet-growth factor receptor alpha genes to the proximal long arm of chromosome 4. (Abstract) Cytogenet. Cell Genet. 51:990, 1989.

3001. Gronwald, R. G. K.; Adler, D. A.; Kelly, J. D.; Disteche, C. M.; Bowen-Pope, D. F.: The human PDGF receptor alpha-subunit gene maps to chromosome 4 in close proximity to c-kit. Hum. Genet. 85: 383-385, 1990.

3002. Hol, F. A.; Geurds, M. P. A.; Chatkupt, S.; Shugart, Y. Y.; Balling, R.; Schrander-Stumpel, C. T. R. M.; Johnson, W. G.; Hamel, B. C. J.; Mariman, E. C. M.: PAX genes and human neural tube defects: an amino acid substitution in PAX1 in a patient with spina bifida. J. Med. Genet. 8: 655-660, 1996.

3003. Hsieh, C.-L.; Navankasattusas, S.; Escobedo, J. A.; Williams, L. T.; Francke, U.: Chromosomal localization of the gene for AA-type platelet-derived growth factor receptor (PDGFRA) in humans and mice. Cytogenet. Cell Genet. 56: 160-163, 1991.

3004. Ikuno, Y.; Kazlauskas, A.: TGF-beta-1-dependent contraction of fibroblasts is mediated by th PDGF-alpha receptor. Invest. Ophthal. Vis. Sci. 43: 41-46, 2002.

3005. Joosten, P. H. L. J.; Hol, F. A.; van Beersum, S. E. C.; Peters, H.; Hamel, B. C. J.; Afink, G. B.; van Zoelen, E. J. J.; Mariman, E. C. M.: Altered regulation of platelet-derived growth factor receptor-alpha gene-transcription in vitro by spina bifida-associated mutant Pax1 proteins. Proc. Nat. Acad. Sci. 95: 14459-14463, 1998.

3006. Lin, F.; Worman, H. J.: Structural organization of the human gene (LMNB1) encoding nuclear lamin B1. Genomics 27: 230-236, 1995.

3007. Maeno, H.; Sugimoto, K.; Nakajima, N.: Genomic structure of the mouse gene (Lmnbl) encoding nuclear lamin B1. Genomics 30: 342-346, 1995.

3008. Kanzaki, T.; Olofsson, A.; Moren, A.; Wernstedt, C.; Hellman, U.; Miyazono, K.; Claesson-Welsh, L.; Heldin, C. H.: TGF-beta 1 binding protein: a component of the large latent complex of TGF-beta 1 with multiple repeat sequences. Cell 61: 1051-1061, 1990.

3009. Oklu, R.; Hesketh, R.: The latent transforming growth factor beta binding protein (LTBP) family. Biochem. J. 352: 601-610, 2000.

3010. Stenman, G.; Sahlin, P.; Olofsson, A.; Geurts van Kessel, A.; Miyazono, K.: Assignment of the gene encoding the latent TGF-beta-1-binding protein (LTBP1) to human chromosome 2, region p12-q22. Cytogenet. Cell Genet. 66: 117-119, 1994.

3011. Wydner, K. L.; McNeil, J. A.; Lin, F.; Worman, H. J.; Lawrence, J. B.: Chromosomal assignment of human nuclear envelope protein genes LMNA, LMNB1, and LBR by fluorescence in situ hybridization. Genomics 32:474-478, 1996.

3012. Furukawa, K.; Hotta, Y.: cDNA cloning of a germ cell specific lamin B3 from mouse spermatocytes and analysis of its function by ectopic expression in somatic cells. EMBO J. 12: 97-106, 1993.

3013. Furukawa, K.; Inagaki, H.; Hotta, Y.: Identification and cloning of an mRNA coding for a germ cell-specific A-type lamin in mice. Exp. Cell Res. 212: 426-430, 1994.

3014. Cohen, A. J.; Li, F. P.; Berg, S.; Marchetto, D. J.; Tsai, S.; Jacobs, S. C.; Brown, R. S.: Hereditary renal-cell carcinoma associated with chromosomal translocation. New Eng. J. Med. 301: 592-595, 1979.

3015. Gemmill, R. M.; West, J. D.; Boldog, F.; Tanaka, N.; Robinson, L. J.; Smith, D. I.; Li, F.; Drabkin, H. A.: The hereditary renal cell carcinoma 3;8 translocation fuses FHIT to a patched-related gene, TRC8. Proc. Nat. Acad. Sci. 95: 9572-9577, 1998.

3016. Krissansen, G. W.; Yuan, Q.; Jenkins, D.; Jiang, W.-M.; Rooke, L.; Spurr, N. K.; Eccles, M.; Leung, E.; Watson, J. D.: Chromosomal locations of the genes coding for the integrin beta-6 and beta-7 subunits. Immunogenetics 35: 58-61, 1992.

3017. Baker, E.; Sutherland, G. R.; Jiang, W.-M.; Yuan, Q.; Leung, E.; Watson, J. D.; Krissansen, G. W.: Mapping of the human integrin beta-7 gene (ITG-beta-7) to 12q13.13 by non-isotopic in situ hybridization. Mammalian Genome 2: 272-273, 1992.

3018. Erle, D. J.; Ruegg, C.; Sheppard, D.; Pytela, R.: Complete amino acid sequence of an integrin beta subunit (beta-7) identified in leukocytes. J. Biol. Chem. 266: 11009-11016, 1991.

3019. Yuan, Q.; Kozak, C. A.; Jiang, W.; Hollander, D.; Watson, J. D.; Krissansen, G. W.: Genetic mapping of the gene coding for the integrin beta-7 subunit to the distal part of mouse chromosome 15. Immunogenetics 35:403-407, 1992.

3020. Siegelmann-Danieli, N.; Buetow, K. H.: Constitutional genetic variation at the human aromatase gene (Cyp19) and breast cancer risk. Brit. J. Cancer 79: 456-463, 1999.

3021. Simpson, E. R.; Michael, M. D.; Agarwal, V. R.; Hinshelwood, M. M.; Bulun, S. E.; Zhao, Y.: Expression of the CYP19 (aromatase) gene: an unusual case of alternative promoter usage. FASEB J. 11: 29-36, 1997.

3022. Sparkes, R. S.; Mohandas, T.; Chen, S.; Besman, M. J.; Zollman, S.; Shively, J. E.: Assignment of the aromatase gene to human chromosome 15q21. (Abstract) Cytogenet. Cell Genet. 46: 696-697, 1987.

3023. Toda, K.; Merashima, M.; Kawamoto, T.; Sumimoto, H.; Yokoyama, Y.; Kuribayashi, I.; Mitsuuchi, Y.; Maeda, T.; Yamamoto, Y.; Sagara, Y.; Ikeda, H.; Shizuta, Y.: Structural and functional characterization of human aromatase P-450 gene. Europ. J. Biochem. 193: 559-565, 1990.

3024. Wang, Z. J.; Jeffs, B.; Ito, M.; Achermann, J. C.; Yu, R. N.; Hales, D. B.; Jameson, J. L.: Aromatase (Cyp19) expression is up-regulated by targeted disruption of Dax1. Proc. Nat. Acad. Sci. 98: 7988-7993, 2001.

3025. Whitlock, J. P., Jr.: The regulation of cytochrome P-450 gene expression. Annu. Rev. Pharm. Toxicol. 26: 333-369, 1986.

3026. Zhou, D.; Pompon, D.; Chen, S.: Structure-function studies of human aromatase by site-directed mutagenesis: kinetic properties of mutants pro308-to-phe, tyr361-to-phe, tyr361-to-leu, and phe406-to-arg. Proc. Nat. Acad. Sci. 88: 410-414, 1991.

3027. McDonald, P. H.; Chow, C.-W.; Miller, W. E.; Laporte, S. A.; Field, M. E.; Lin, F.-T.; Davis, R. J.; Lefkowitz, R. J.: Beta-arrestin2: a receptor-regulated MAPK scaffold for the activation of JNK3. Science 290:1574-1577, 2000.

3028. Masi, L.; Becherini, L.; Colli, E.; Gennari, L.; Mansani, R.; Falchetti, A.; Becorpi, A. M.; Cepollaro, C.; Gonnelli, S.; Tanini, A.; Brandi, M. L.: Polymorphisms of the calcitonin receptor gene are associated with bone mineral density in postmenopausal Italian women. Biochem. Biophys. Res. Commun. 248: 190-195, 1998.

3029. Masi, L.; Becherini, L.; Gennari, L.; Colli, E.; Mansani, R.; Falchetti, A.; Cepollaro, C.; Gonnelli, S.; Tanini, A.; Brandi, M. L.: Allelic variants of human calcitonin receptor: distribution and association with bone mass in post-menopausal Italian women. Biochem. Biophys. Res. Commun. 245: 622-626, 1998.

3030. Nakamura, M.; Zhang, Z. Q.; Shan, L.; Hisa, T.; Sasaki, M.; Tsukino, R.; Yokoi, T.; Kaname, A.; Kakudo, K.: Allelic variants of human calcitonin receptor in the Japanese population. Hum. Genet. 99:38-41, 1997.

3031. Perezjurado, L. A.; Li, X.; Francke, U.: The human calciton inreceptor gene (CALCR) at 7q21.3 is outside the deletion associated with the Williams syndrome. Cytogenet. Cell Genet. 70: 246-249, 1995.

3032. Taboulet, J.; Frendo, J. L.; Delage-Murroux, R.; Pichaud, F.; deVernejoul, M. C.; Jullienne, A.: Evidence for 2 allelic forms of calcitonin receptor gene: distribution in normal and osteoporotic women. (Abstract) J. Bone Miner. Res. 11 (suppl. 1): S204, 1996.

3033. Taboulet, J.; Frenkian, M.; Frendo, J. L.; Feingold, N.; Jullienne, A.; de Vernejoul, M. C.: Calcitonin receptor polymorphism is associated with a decreased fracture risk in post-menopausal women. Hum. Molec. Genet. 7: 2129-2133, 1998.

3034. Doray, B.; Ghosh, P.; Griffith, J.; Geuze, H. J.; Kornfeld, S.: Cooperation of GGAs and AP-1 in packaging MPRs at the trans-Golgi network. Science 297: 1700-1703, 2002.

3035. Li, X.-Y.; Mattei, M. G.; Zaleska-Rutczynska, Z.; Hooft van Huijsduijnen, R.; Figueroa, F.; Nadeau, J.; Benoist, C.; Mathis, D.: One subunit of the transcription factor NF-Y maps close to the major histocompatibility-complex in murine and human chromosomes. Genomics 11: 630-634, 1991.

3036. Aasland, R.; Olsen, L. C.; Spurr, N. K.; Krokan, H. E.; Helland, D. E.: Chromosomal assignment of human uracil*DNA glycosylase to chromosome 12. Genomics 7: 139-141, 1990.

3037. Dinner, A. R.; Blackburn, G. M.; Karplus, M.: Uracil-DNA glycolase acts by substrate autocatalysis. Nature 413: 752-755, 2001.

3038. Haug, T.; Skorpen, F.; Kvaloy, K.; Eftedal, I.; Lund, H.; Krokan, H. E.: Human uracil-DNA glycosylase gene: sequence organization, methylation pattern, and mapping to chromosome 12q23-q24.1. Genomics 36:408-416, 1996.

3039. Haug, T.; Skorpen, F.; Lund, H.; Krokan, H. E.: Structure of the gene for human uracil-DNA glycosylase and analysis of the promoter function. FEBS Lett. 353: 180-184, 1994.

3040. Meyer-Siegler, K.; Mauro, D. J.; Seal, G.; Wurzer, J.; deRiel, J. K.; Sirover, M. A.: A human nuclear uracil DNA glycosylase is the 37-kDa subunit of glyceraldehyde-3-phosphate dehydrogenase. Proc. Nat. Acad. Sci. 88: 8460-8464, 1991.

3041. Nilsen, H.; Rosewell, I.; Robins, P.; Skjelbred, C. F.; Andersen, S.; Slupphaug, G.; Daly, G.; Krokan, H. E.; Lindahl, T.; Barnes, D. E.: Uracil-DNA glycosylase (UNG)-deficient mice reveal a primary role of the enzyme during DNA replication. Molec. Cell 5: 1059-1065, 2000.

3042. Olsen, L. C.; Aasland, R.; Wittwer, C. U.; Krokan, H. E.; Helland, D. E.: Molecular cloning of human uracil-DNA glycosylase, a highly conserved DNA repair enzyme. EMBO J. 8: 3121-3125, 1989.

3043. Vollberg, T. M.; Siegler, K. M.; Cool, B. L.; Sirover, M. A.: Isolation and characterization of the human uracil DNA glycosylase gene. Proc. Nat. Acad. Sci. 86: 8693-8697, 1989.

3044. Momeni, P.; Glockner, G.; Schmidt, O.; von Holtum, D.; Albrecht, B.; Gillessen-Kaesbach, G.; Hennekam, R.; Meinecke, P.; Zabel, B.; Rosenthal, A.; Horsthemke, B.; Ludecke, H.-J.: Mutations in a new gene, encoding a zinc-finger protein, cause tricho-rhino-phalangeal syndrome type I. Nature Genet. 24: 71-74, 2000.

3045. He, Z.; Yamamoto, R.; Furth, E. E.; Schantz, L. J.; Naylor, S. L.; George, H.; Biliheimer, J. T.; Strauss, J. F., III: cDNAs encoding members of a family of proteins related to human sterol carrier protein 2 and assignment of the gene to human chromosome 1p21-pter. DNA Cell Biol. 10: 559-569, 1991.

3046. Vesa, J.; Hellsten, E.; Barnoski, B. L.; Emanuel, B. S.; Billheimer, J. T.; Mead, S.; Cowell, J. K.; Strauss, J. F., III; Peltonen, L.: Assignment of sterol carrier protein X/sterol carrier protein 2 to 1p32 and its exclusion as the causative gene for infantile neuronalceroid lipofuscinosis. Hum. Molec. Genet. 3: 341-346, 1994.

3047. Welch, C. L.; Xia, Y.-R.; Billheimer, J. T.; Strauss, J. F., III; Lusis, A. J.: Assignment of the mouse sterol carrier protein gene (Scp2) to chromosome 4. Mammalian Genome 7: 624-625, 1996.

3048. Yamamoto, R.; Kallen, C. B.; Babalola, G. O.; Rennert, H.; Billheimer, J. T.; Strauss, J. F., III: Cloning and expression of a cDNA encoding human sterol carrier protein 2. Proc. Nat. Acad. Sci. 88: 463-467, 1991.

3049. Yamamoto, R.; Naylor, S. L.; George, H.; Billheimer, J. T.; Strauss, J. F., III: Assignment of the gene encoding sterol carrier protein 2 to human chromosome 1pter-p21. (Abstract) Cytogenet. Cell Genet. 58:1866-1867, 1991.

3050. To be, K.; Suzuki, R.; Aoyama, M.; Yamauchi, T.; Kamon, J.; Kubota, N.; Terauchi, Y.; Matsui, J.; Akanuma, Y.; Kimura, S.; Tanaka, J.; Abe, M.; Ohsumi, J.; Nagai, R.; Kadowaki, T.: Increased expression of the sterol regulatory element-binding protein-1 gene in insulin receptor substrate-2-/- mouse liver. J. Biol. Chem. 276: 38337-38340, 2001.

3051. Joosten, P. H. L. J.; Toepoel, M.; Mariman, E. C. M.; Van Zoelen, E. J. J.: Promoter haplotype combinations of the platelet-derived growth factor alpha-receptor gene predispose to human neural tube defects. Nature Genet. 27: 215-217, 2001.

3052. Fox, G. M.; Holst, P. L.; Chute, H. T.; Lindberg, R. A.; Janssen, A. M.; Basu, R.; Welcher, A. A.: cDNA cloning and tissue distribution of five human EPH-like receptor protein-tyrosine kinases. Oncogene 10:897-905, 1995.

3053. Ludecke, H.-J.; Schaper, J.; Meinecke, P.; Momeni, P.; Gross, S.; von Holtum, D.; Hirche, H.; Abramowicz, M. J.; Albrecht, B.; Apacik, C.; Christen, H.-J.; Claussen, U.; and 28 others: Genotypic and phenotypic spectrum in trichorhino-phalangeal syndrome types I and III. Am. J. Hum. Genet. 68: 81-91, 2001.

3054. Chan, J.; Watt, V. M.: Eek and erk, new members of the eph subclass of receptor protein-tyrosine kinases. Oncogene 6: 1057-1061, 1991.

3055. Colucci, F.; Schweighoffer, E.; Tomasello, E.; Turner, M.; Ortaldo, J. R.; Vivier, E.; Tybulewicz, V. L. J.; Di Santo, J. P.: Natural cytotoxicity uncoupled from the Syk and ZAP-70 intracellular kinases. Nature Immun. 3: 288-294, 2002.

3056. Levine, A.; Cantoni, G. L.; Razin, A.: Inhibition of promoter activity by methylation: possible involvement of protein mediators. Proc. Nat. Acad. Sci. 88: 6515-6518, 1991.

3057. Nan, X.; Meehan, R. R.; Bird, A.: Dissection of the methyl-CpG binding domain from the chromosomal protein MeCP2. Nucleic Acids Res. 21: 4886-4892, 1993.

3058. Ohki, I.; Shimotake, N.; Fujita, N.; Jee, J.-G.; Ikegami, T.; Nakao, M.; Shirakawa, M.: Solution structure of the methyl-CpG binding domain of human MBD1 in complex with methylated DNA. Cell 105: 487-497, 2001.

3059. Romashkova, J. A.; Makarov, S. S.: NF-kappa-B is a target of AKT in anti-apoptotic PDGF signalling. Nature 401: 86-90, 1999.

3060. Sanyal, S.; Sandstrom, D. J.; Hoeffer, C. A.; Ramaswami, M.: AP-1 function upstream of CREB to control synaptic plasticity in Drosophila. Nature 416:870-874, 2002.

3061. Takahashi, E.; Hori, T.; O'Connell, P.; Leppert, M.; White, R.: R-banding and nonisotopic in situ hybridization: precise localization of the human type II collagen gene (COL2A1). Hum. Genet. 86: 14-16, 1990.

3062. Takahashi, E.; Yamauchi, M.; Tsuji, H.; Hitomi, A.; Meuth, M.; Hori, T.: Chromosome mapping of the human cytidine-5-prime-triphosphate synthetase (CTPS) gene to band 1p34.1-p34.3 by fluorescence in situ hybridization. Hum. Genet. 88: 119-121, 1991.

3063. Takahashi, E.-I.; Yamauchi, M.; Ayusawa, D.; Kaneda, S.; Seno, T.; Meuth, M.; Hori, T.-A.: Chromosome mappings of the human cytidine-5-prime-triphosphate synthetase (CTPS) gene and the human ubiquitin-activating enzyme UBE1 gene by fluorescence in situ hybridization. (Abstract) Cytogenet. Cell Genet. 58: 1864 only, 1991.

3064. Thomas, P. E.; Sen, S.; Lamb, B. J.; Chu, E. H. Y.: Cloning and expression of mammalian CTP synthetase genes. (Abstract) Am. J. Hum. Genet. 45 (suppl.): All only, 1989.

3065. Whelan, J.; Phear, G.; Yamauchi, M.; Meuth, M.: Clustered base substitutions in CTP synthetase conferring drug resistance in Chinese hamster ovary cells. Nature Genet. 3: 317-322, 1993.

3066. Yamauchi, M.; Takahashi, E.; Whelan, J.; Phear, G.; Meuth, M.: Mapping and functional analysis of the cytidine triphosphate synthetase (CTPS) gene. (Abstract) Human Genome Mapping Workshop 93 1 only, 1993.

Lengthy table referenced here

US07790867-20100907-T00001

Please refer to the end of the specification for access instructions.

Lengthy table referenced here

US07790867-20100907-T00002

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US07790867B2). An electronic copy of the table will also be available from the USPTO upon request and payment of the fee set forth in 37 CFR 1.19(b)(3).

SEQUENCE LISTING (3760 sequences)

SEQ ID NO: 1 - DNA, 123 bp, Vaccinia Virus
acctctttctgatggagtcgtaaaaaagttttatctctttctctcttcgatggtctcacaaaaatattaaacctctttctgatggagtcgtaaaaaagttttatctctttctccttcgatggt

SEQ ID NO: 2 - DNA, 124 bp, Vaccinia Virus
acctctttctgatggagtcgtaaaaaagttttatctctttctctcttcgatggtctcacaaaaatattaaacctctttctgatggagtcgtaaaaaagttttatctctttctctcttcgatggt

SEQ ID NO: 3 - DNA, 124 bp, Vaccinia Virus; identical to SEQ ID NO: 2

SEQ ID NO: 4 - DNA, 124 bp, Vaccinia Virus; identical to SEQ ID NO: 2

SEQ ID NO: 5 - DNA, 124 bp, Vaccinia Virus; identical to SEQ ID NO: 2

SEQ ID NO: 6 - DNA, 124 bp, Vaccinia Virus; identical to SEQ ID NO: 2

SEQ ID NO: 7 - DNA, 124 bp, Vaccinia Virus; identical to SEQ ID NO: 2

SEQ ID NO: 8 - DNA, 124 bp, Vaccinia Virus; identical to SEQ ID NO: 2

SEQ ID NO: 9 - DNA, 124 bp, Vaccinia Virus; identical to SEQ ID NO: 2

SEQ ID NO: 10 - DNA, 124 bp, Vaccinia Virus; identical to SEQ ID NO: 2

SEQ ID NO: 11 - DNA, 124 bp, Vaccinia Virus; identical to SEQ ID NO: 2

SEQ ID NO: 12 - DNA, 122 bp, Vaccinia Virus
acctctttctgatggagtcgtaaaaaagttttatctttctctcttcgatggtctcacaaaaatattaaacctctttctgatggagtcgtaaaaaagttttatctctttctctcttcgatggt

SEQ ID NO: 13 - DNA, 100 bp, Vaccinia Virus
gatggagtcgtaaaaaagttttatctctttctccttcgatggtctcacaaaaatattaaacctctttctgatggagtcgtaaaaaagttttatctctttc

SEQ ID NO: 14 - DNA, 100 bp, Vaccinia Virus; identical to SEQ ID NO: 13

SEQ ID NO: 15 - DNA, 101 bp, Vaccinia Virus
gatggagtcgtaaaaaagttttatctctttctctcttcgatggtctcacaaaaatattaaacctctttctgatggagtcgtaaaaaagttttatctctttc

SEQ ID NO: 16 - DNA, 115 bp, Vaccinia Virus
gatggtctcataaaaaaagttttacaaaaatatttttattctctttctctctttgatggtctcataaaaaaagttttacaaaaatatttttattctctttctctctttgatggtc

SEQ ID NO: 17 - DNA, 96 bp, Vaccinia Virus
ggagtcataaaatatttttattctctttctctcttcgatggtctcacaaaaatattaaacctctttctgatggagtcgtaaaaaagttttatctct

SEQ ID NO: 18 - DNA, 130 bp, Vaccinia Virus
ttaaacctctttctgatggagtcgtaaaaaagttttatctctttctccttcgatggtctcacaaaaatattaaacctctttctgatggagtcgtaaaaaagttttatctctttctcctttctcacaaaaa

SEQ ID NO: 19 - DNA, 130 bp, Vaccinia Virus; identical to SEQ ID NO: 18

SEQ ID NO: 20 - DNA, 91 bp, Vaccinia Virus
tttttctttggtacaaaatttcacacaagtttttatacagacaaattcttgtccatatattttaaaacattgacttttgtactaagaaaaa

SEQ ID NO: 21 - DNA, 96 bp, Vaccinia Virus
agagataaaacttttttacgactccatcagaaagaggtttaatatttttgtgagaccatcgaaggagactccatcagaaagaggtttaatattttt

SEQ ID NO: 22 - DNA, 70 bp, Vaccinia Virus
ataaaaatatttttgtaaaactttttttatgagaccatcaaagagagaaagagaataaaaatatttttgt

SEQ ID NO: 23 - DNA, 70 bp, Vaccinia Virus; identical to SEQ ID NO: 22

SEQ ID NO: 24 - DNA, 61 bp, Vaccinia Virus
atggattttactagatcatttatataccaaaaaatattatacgatctacgttttattatat

SEQ ID NO: 25 - DNA, 128 bp, Vaccinia Virus
cttttttacgactccatcagaaagaggtttaatatttttgtgagaccatcgaagagagaaagagataaaacttttttacgactccatcagaaagaggtttaatatttttgtgagaccatcgaagagag

SEQ ID NO: 26 - DNA, 128 bp, Vaccinia Virus; identical to SEQ ID NO: 25

SEQ ID NO: 27 - DNA, 128 bp, Vaccinia Virus; identical to SEQ ID NO: 25

SEQ ID NO: 28 - DNA, 128 bp, Vaccinia Virus; identical to SEQ ID NO: 25

SEQ ID NO: 29 - DNA, 128 bp, Vaccinia Virus; identical to SEQ ID NO: 25

SEQ ID NO: 30 - DNA, 128 bp, Vaccinia Virus; identical to SEQ ID NO: 25

SEQ ID NO: 31 - DNA, 126 bp, Vaccinia Virus
cttttttacgactccatcagaaagaggtttaatatttttgtgagaccatcgaagagagaaagataaaacttttttacgactccatcagaaagaggtttaatatttttgtgagaccatcgaagagag

SEQ ID NO: 32 - DNA, 71 bp, Vaccinia Virus
gtgtgcctgaatcgttcgattaaccctactcatccaatttcagatgaatagagttatcgattcagacacac

SEQ ID NO: 33 - DNA, 75 bp, Vaccinia Virus
tcagaaagaggtttaatatttttgtgagaccatcgaagagagaaagagaataaaaatattttatgactccattga

SEQ ID NO: 34 - DNA, 131 bp, Vaccinia Virus
ttttatgagaccatcaaagagagaaagagaataaaaatatttttgtaaaactttttttatgagaccatcaaagagagaaagagaataaaaatatttttgtaaaactttttttatgagaccatcaaagagag

SEQ ID NO: 35 - DNA, 131 bp, Vaccinia Virus
ttttatgagaccatcaaagagagaaagagaataaaaatatttttgtaaaactttttttgtgagaccatcgaagagagaaagagaataaaaatatttttgtaaaactttttttatgagaccatcaaagagag

SEQ ID NO: 36 - DNA, 91 bp, Vaccinia Virus
tttttcttagtacaaaagtcaatgttttaaaatatatggacaagaatttgtctgtataaaaacttgtgtgaaattttgtaccaaagaaaaa

SEQ ID NO: 37 - DNA, 126 bp, Vaccinia Virus
atgtagtaatcgttgtcgtgttcctgtttcctacttctccaatcatatagatattttctttctatcatggataatatttgtaatggttctttccgtacaacatactgtttagatgatattgcgcat

SEQ ID NO: 38 - DNA, 72 bp, Vaccinia Virus
gaatgactcgtcccttaataggcagtaggctagtatcttttttacgtagtaatcgtcgtagggagagaattc

SEQ ID NO: 39 - DNA, 79 bp, Vaccinia Virus
gagattgtatcagtttcgtagtcttgagtattggtattactatatagtatatagatgtcgacgctagatatacagtctc

SEQ ID NO: 40 - DNA, 79 bp, Vaccinia Virus
ggcaaatcttatcattggtcggtgtttggtcttgctttgtgactttgataataacatcgattcccatatgatgtttgtt

SEQ ID NO: 41 - DNA, 102 bp, Vaccinia Virus
agtatgttgtacggaaagaaccattacaaatattatccatgatagaaagaaaatatctatatgattggagaagtaggaaacaggaacacgacaacgattact

SEQ ID NO: 42 - DNA, 63 bp, Vaccinia Virus
aaaatcgattccgtccaagatgataaaaacatttaccggcatcataaacacggagtttatttt

SEQ ID NO: 43 - DNA, 73 bp, Vaccinia Virus
catggagatactttattactccattaaataatttatcatggagtgataatgtcctgtttcatttgtttccatg

SEQ ID NO: 44 - DNA, 73 bp, Vaccinia Virus
actgtatgctcctagcggagttaatccttcgttgtttctacaaagtctctcgactccgcgagagagtaacagt

SEQ ID NO: 45 - DNA, 63 bp, Vaccinia Virus
atacggaatatctacgtccatgtcattattgtcatcgggtgtattctcattcatattctctat

SEQ ID NO: 46 - DNA, 67 bp, Vaccinia Virus
gcaatacttctggtctcggattaggcgtcgttacgtatatatccaccaatccgagaccattgattgc

SEQ ID NO: 47 - DNA, 98 bp, Vaccinia Virus
gctttgcaaattgtatattattgacatcgaccgcgtaatatagtagagttttattctcattatcgatcatatctatatcatccatgtacttgcttagt

SEQ ID NO: 48 - DNA, 78 bp, Vaccinia Virus
gtcgttctcgttcagaatctttcgcagcataagtagtatgtcgatatacttatcgttgaagactcttccagagacgat

SEQ ID NO: 49 - DNA, 60 bp, Vaccinia Virus
taacaatatattattagtttatattactgaattaataatataaaattcccaatcttgtta

SEQ ID NO: 50 - DNA, 68 bp, Vaccinia Virus
tctcaataagaagattaacgatttccatgtctacattatatggggttactctaaatcgcttgtttaga

SEQ ID NO: 51 - DNA, 88 bp, Vaccinia Virus
tgtattcagtcagacaatgtctgacgtcggccacggtattcagggagtccttagtagcgtggcaatgacagggtctgaactgggcaca

SEQ ID NO: 52 - DNA, 88 bp, Vaccinia Virus
ttgatattacttataataacgatttgtttaatttttagtttatactattaattgtaaatgatattattatttttttaagtattatcag

SEQ ID NO: 53 - DNA, 63 bp, Vaccinia Virus
tttaaactttggcatatacaagtctatacttttagtagataacataccacaccattttttaaa

SEQ ID NO: 54 - DNA, 75 bp, Vaccinia Virus
tttcttttcacgatgcatcttattgaatgacgttttctcataagtggacatatagatgcagaagtaatgaagaaa

SEQ ID NO: 55 - DNA, 62 bp, Vaccinia Virus
tcgatgatacatgtattaaaatactttccgaataagtcttttaaatattgtattaattatga

SEQ ID NO: 56 - DNA, 86 bp, Vaccinia Virus
tgataatacttaaaaaaataataatatcatttacaattaatagtataaactaaaaattaaacaaatcgttattataagtaatatca

SEQ ID NO: 57 - DNA, 64 bp, Vaccinia Virus
agcagcgaacaacaacatcagatatttcatcgacatttttgatggattctgtgtttatgctgtt

SEQ ID NO: 58 - DNA, 60 bp, Vaccinia Virus
taacaagattgggaattttatattattaattcagtaatataaactaataatatattgtta

SEQ ID NO: 59 - DNA, 89 bp, Vaccinia Virus
tacatgctgacatctaatgcctgtataaccatgagagcatctacaatacataccgtcgatatctctagcgtggatacagtcaccgtgta

SEQ ID NO: 60 - DNA, 81 bp, Vaccinia Virus
tccgtttttatcagtatgtatatctatattaacgtcgtcgttgtagtgaatagtagttattgatctattatatgaaacgga

SEQ ID NO: 61 - DNA, 100 bp, Vaccinia Virus
tgctaaatatgcgatgtatctatgttatttgtatttatctaaacaatacctctacctctagatattatacaaaaattttttatttcagcatattaaagta

SEQ ID NO: 62 - DNA, 85 bp, Vaccinia Virus
ttttgattacgatgttataagaatgtagttaattgatgtatgatgttaatgtgtcctctttcctcttataacatcgtaatcaaaa

SEQ ID NO: 63 - DNA, 63 bp, Vaccinia Virus
gattttgtgatttttcttcctaaactgtttacgtaaatagttagatagaatattcattagttc

SEQ ID NO: 64 - DNA, 81 bp, Vaccinia Virus
gcgtcaaatatttcccgtttaatatcgcatttgtcaagataataatagagtgtggtatgttcacgataagtataataacgc

SEQ ID NO: 65 - DNA, 65 bp, Vaccinia Virus
tatcttttaagaattgtggatattaggatattattacgtaaactattacacaattctaaaatata

SEQ ID NO: 66 - DNA, 60 bp, Vaccinia Virus
atttagactgatgtatgggtaatagtgtttgaagagctcgttctcatcatcagaataaat

SEQ ID NO: 67 - DNA, 63 bp, Vaccinia Virus
agccgctgagtggtaaacaacagaacagatagtttattatctttaccaacaccctcagccgct

SEQ ID NO: 68 - DNA, 82 bp, Vaccinia Virus
gactagatccgttagtttaatatcctcagtcatcttgtctagaatggcaaatctaactgcgggtttaggctttagtttagtt

SEQ ID NO: 69 - DNA, 78 bp, Vaccinia Virus
ggatgtaaaatgttgatgatatctacatcgtttggatttttatgtatccactttaataatatcatagctgtaacatcc

SEQ ID NO: 70 - DNA, 60 bp, Vaccinia Virus
gtccgtatccagtcaacactatgttagcatttctgtcgatatagctttcactcatatgac

SEQ ID NO: 71 - DNA, 126 bp, Vaccinia Virus
tagctttcatagttagatacatggtctcagaagtaggattatgtaacatcagcttcgataaaatgactgggttatttagtcttacacattcgctcatacatgtatgaccgttaactacagagtcta

SEQ ID NO: 72 - DNA, 66 bp, Vaccinia Virus
tcgtaagatactccttcatgaacataatcagttacaaaacgtttatatgaagtaaagtatctacga

SEQ ID NO: 73 - DNA, 72 bp, Vaccinia Virus
ttcaccgtttgcatgttaccactatcaaccgcataatacaatgcggtgtttcctttgtcatcaaattgtgaa

SEQ ID NO: 74 - DNA, 91 bp, Vaccinia Virus
tttcaggagatgatctcgccgtagctaccatgatagtagatgcctctgctacagttccttgttcgtcgacatctatctttgcattctgaaa

SEQ ID NO: 75 - DNA, 105 bp, Vaccinia Virus
tgatgcattaatttttgtattgattctcaatcctaaaaactaaaatatgaataagtattaaacatagcggtgtactaattgatttaacataaaaaatagttgtta

SEQ ID NO: 76 - DNA, 72 bp, Vaccinia Virus
gttgttttgcgatagccatgtatctactaatcagatctattagagatattattaattctggtgcaatatgac

SEQ ID NO: 77 - DNA, 78 bp, Vaccinia Virus
actgattctggacatagctttccgactggcgcatttggtgtgatggttcccataagtttggcagctagcagattcagt

SEQ ID NO: 78 - DNA, 70 bp, Vaccinia Virus
atatgtgtattatcagatatccaaaattttgtatgaagaactcctcctaggatatttgtaatatctatgt

SEQ ID NO: 79 - DNA, 75 bp, Vaccinia Virus
atcatcattttttcaccattacttcttccatgtccaatatgatcatgtgagaatactaaaattcctaacgatgat

SEQ ID NO: 80 - DNA, 68 bp, Vaccinia Virus
gaaattgttgctcccatggaatgacccaataagtagatttaatagttaccacgtgctgtaccaaagtc

SEQ ID NO: 81 - DNA, 65 bp, Vaccinia Virus
tggttctttccatagtacatagttgttgcggtgcagaagcaataaatacagagtgtggaacacca

SEQ ID NO: 82 - DNA, 129 bp, Vaccinia Virus
ttaatagtttacaccttttagtaggactagtatcgtacaattcatagctgtattttgaattccaatcacgcataaaaatatcttccaattgttgacgaagacctaatccatcatccggtgtaatattaa

SEQ ID NO: 83 - DNA, 62 bp, Vaccinia Virus
ttcatccgataaactccaataaaaagatgatatatctagtgtttttgtggtattggatagaa

SEQ ID NO: 84 - DNA, 75 bp, Vaccinia Virus
ttagtgacagaccagacctaggagctattctaccatagcaaatcttaggcatggacatactaatatctgtcttaa

SEQ ID NO: 85 - DNA, 66 bp, Vaccinia Virus
aacaaagaaatggaaatcgtaataccagttatgtttaactttgaaattgttttttattttcttgtt

SEQ ID NO: 86 - DNA, 69 bp, Vaccinia Virus
ttccactgtccaaaatgatgcctctgcctttttatacatgttccagatgtcataatattggattgggaa

SEQ ID NO: 87 - DNA, 103 bp, Vaccinia Virus
ctgtgaccaagatagagagctcctttggtgaatccatctctatgtttcagtttaaccaagaaacagtcagctggtctaaaatttccatctctatctaatacag

SEQ ID NO: 88 - DNA, 60 bp, Vaccinia Virus
gtttcttttagaagtgattctttgatggtgtcagcatacgaattacaataatgcagaaac

SEQ ID NO: 89 - DNA, 67 bp, Vaccinia Virus
ttgatacgatatttgttggattcctgattatttactataatataatctagacagatagatgattcga

SEQ ID NO: 90 - DNA, 62 bp, Vaccinia Virus
aatatcgggccaatagtagctattaccgtcgacacgtgtagtgggaactatggccaaatgtt

SEQ ID NO: 91 - DNA, 62 bp, Vaccinia Virus
agacttctggcggttgccatagaatatacgtcgttcttatcccaattaccaactagaagtct

SEQ ID NO: 92 - DNA, 116 bp, Vaccinia Virus
gaagtttttggagaataatatgactcatgatctatttcgtccataaacaatctagacataggaattggaggcgatgatcttaattttgtgcaatgagtcgtcaatcctataacttc

SEQ ID NO: 93 - DNA, 71 bp, Vaccinia Virus
taatccctttttcagatgcctcttttagtttatcaaaaataagcgctcccctagtcgtactcagaggatta

SEQ ID NO: 94 - DNA, 73 bp, Vaccinia Virus
ttaaatagttacgcaatatctcaatagtttcataattgttagctgttttcatcaagatttgtaccctgtttaa

SEQ ID NO: 95 - DNA, 68 bp, Vaccinia Virus
tgccgttactattatttataactgatgtaacccacgtaacattggaattaactatcgatagtaatgca

SEQ ID NO: 96 - DNA, 93 bp, Vaccinia Virus
acacgcgtgtctaactagtggaggttcgtcagctgctctagtttgaatcatcatcggcgtagtattcctacttttacagttaggacacggtgt

SEQ ID NO: 97 - DNA, 62 bp, Vaccinia Virus
cagcatccggcttatccgcctccgttgtcataaaccaacgaggaggaatatcgtcggagctg

SEQ ID NO: 98 - DNA, 60 bp, Vaccinia Virus
ccattaatatctctattatagcttctggacataattcatctattataccagaattaatgg

SEQ ID NO: 99 - DNA, 122 bp, Vaccinia Virus
cttcattatgaattgattcttgaggtataaacctaacacaaattatattattagacttttcgtatgtaatgtctttcatgttataagtttttaatcctggaatagaatctattttaatgagg

SEQ ID NO: 100 - DNA, 61 bp, Vaccinia Virus
gaagagatgtaacgggaacagggtttgttgattcgcaaactattctaatacataattcttc

SEQ ID NO: 101 - DNA, 74 bp, Vaccinia Virus
gttaatacgtcttgcacgtaatctattatagatgccaagatatctatataattattttgtaagatgatgttaac

SEQ ID NO: 102 - DNA, 127 bp, Vaccinia Virus
gtttttgatatcgatctgattgatcctagaactagatatattaataacgtgctcattaggcagtttatggcagcttgataattagatatagtatattccagttcatatttattagataccgcattgc

SEQ ID NO: 103 - DNA, 87 bp, Vaccinia Virus
taatggtgacagggttagcatctttccaatcaataatttttttagccggaataacatcatcaaaagacttatgatcctctctcattg

SEQ ID NO: 104 - DNA, 100 bp, Vaccinia Virus
tcgtttagattttccatctgccttatcgaatactcttccgtcgatgtctacacaggcataaaatgtaggagagttactaggcccaactgattcaatacga

SEQ ID NO: 105 - DNA, 62 bp, Vaccinia Virus
tgatgtagtactttgatgatttttccatggcccattctattaagtcttccaagttggcatca

SEQ ID NO: 106 - DNA, 71 bp, Vaccinia Virus
ttggtaactcattctatatatgctttccttgttgatgaaggatagaatatactcaatagaatttgtaccaa

SEQ ID NO: 107 - DNA, 80 bp, Vaccinia Virus
tttctaagatatgggattttacttaatataatattatttcccgtaataaattttattagaaatgccaaatctataagaaa

SEQ ID NO: 108 - DNA, 73 bp, Vaccinia Virus
tctagttatcaataacagttagtagtttagttatacattgaatcatacatattaatttttttattgagataga

SEQ ID NO: 109 - DNA, 60 bp, Vaccinia Virus
tccgcactatcgatttgatactttcttttcagagtaaagctatcgtcattgatcatcgga

SEQ ID NO: 110 - DNA, 125 bp, Vaccinia Virus
ttctagagtagtagtcctaatcattctcttaaattttatgtatcctagtttcaatgtctcgtaatgagtttgtgctgctcttattgtctgatttatttcttttaccattttggctctattctgaa

SEQ ID NO: 111 - DNA, 95 bp, Vaccinia Virus
gatctatagtcttcgtatctgttacgaaaatcaatatattcaggattattttctgaatcacttgattcgtcactaatatacataactatatgatc

SEQ ID NO: 112 - DNA, 60 bp, Vaccinia Virus
tgtacgattgtattgcgttactaaacgataaataattcttagtcaatgctttaacgtaca

SEQ ID NO: 113 - DNA, 68 bp, Vaccinia Virus
gcgtatctactactccaaattgcagtttctggtatccatccatacgcgtaattatcaaatagatatgt

SEQ ID NO: 114 - DNA, 117 bp, Vaccinia Virus
tatatcctaccgctttttatcaactatgtaatgagtttttatgttatgtcttttagttaggttaatattctaataagatgctaatacatcaggttaaagtattagaatgggattata

SEQ ID NO: 115 - DNA, 80 bp, Vaccinia Virus
atcagaccatatactgagttggctactatcttgtacgtatattgcatggaatcatagatggccttttcagttgaactggt

SEQ ID NO: 116 - DNA, 69 bp, Vaccinia Virus
tagtcacgactgaaataaccgcgtgattattttttggtataattctacacggcatggtttctgtgacta

SEQ ID NO: 117 - DNA, 119 bp, Vaccinia Virus
tcatccaatattattgaaatgacgttgatggacagatgatacaaataagaaggtacggtacctttgtccaccatctcctccaattcatgctctattttgtcattaactttaatgtatga

SEQ ID NO: 118 - DNA, 64 bp, Vaccinia Virus
tcgtcggtattttttatggcaaactttactcttccagcatccgtttctaaaaaaatattaacga

SEQ ID NO: 119 - DNA, 62 bp, Vaccinia Virus
accattccaagtcactgtgtgtaagaagattatattctatcataagcttgactacatttggt

SEQ ID NO: 120 - DNA, 84 bp, Vaccinia Virus
atatctttaactaagtcaatgatttcatcaaccgttagatctattttaaagttaatcatataggcattgatttttaaaaggtat

SEQ ID NO: 121 - DNA, 75 bp, Vaccinia Virus
cagccgaaacatattctaccatggctccgtttaatttgttgatgaagatggattcatccttaaatgttttctctg

SEQ ID NO: 122 - DNA, 74 bp, Vaccinia Virus
ccgtttttagaccgagactccatccgtaaaaatgcatactcgttagtttggaataactcggatctgctatatgg

SEQ ID NO: 123 - DNA, 125 bp, Vaccinia Virus
cgcttctatcttgtttagatttatttttataaagtttagtctctccttccaacataataaaagtggaagtcatttgactagataaactatcagtaagttttatagagatagacgaacaattagcg

SEQ ID NO: 124 - DNA, 113 bp, Vaccinia Virus
gacatacatactatctttaatagaactcttttcatccagttgaatggattcgtccttaaccaactgattaatgagatcttctattttatcattttccagatgatatgtatgtc

SEQ ID NO: 125 - DNA, 102 bp, Vaccinia Virus
tacaaaggagatgatttatctatggtattaagaattcgtttttcgacatccgtcaaaaccaattcctttttgcctgtatcatccagttttccatcctttgta

SEQ ID NO: 126 - DNA, 66 bp, Vaccinia Virus
tgtcactttgttattggccaacctttgttgtacaaattcctcggccattttaatatttaagtgata

SEQ ID NO: 127 - DNA, 64 bp, Vaccinia Virus
ttgctagacaccttttcaatgtttaatttttttgaaataagctttgataaagccttcctcgcaa

SEQ ID NO: 128 - DNA, 98 bp, Vaccinia Virus
caccgcctctagatatcgcctttatttccacattagatggtaaatccaatagtgaaactatctttttaggaatgtatggactcgcgtttagaggagtg

SEQ ID NO: 129 - DNA, 63 bp, Vaccinia Virus
gacactttgccggcggttgtagatttatcatatttctccactacatatccgttacaatttgtt

SEQ ID NO: 130 - DNA, 67 bp, Vaccinia Virus
gagacttgatagatattagtgatgaattgaaaattatttttatcaccacgtgtgtttcaggatcatc

SEQ ID NO: 131 - DNA, 79 bp, Vaccinia Virus
ggctattctggcggctagaatggcataatccggatgttgtgtagtacaagtggctgctatttcggctgccagagtgtcc

SEQ ID NO: 132 - DNA, 93 bp, Vaccinia Virus
tatatacgataagatatgtttattcataaacgcgtcaaatttttcatgaatcgctaaggagtttaagaatctcatgtcaaattgtcctatata

SEQ ID NO: 133 - DNA, 63 bp, Vaccinia Virus
tctggttctatgttcctcgtttcctgtattctttttaagatcgaggaacgccataatatcaga

SEQ ID NO: 134 - DNA, 77 bp, Vaccinia Virus
ggaacaaatatagtatctgaaatcatattcatatatcccgttagaggtctatgataatatatagtagcgtttgttcc

SEQ ID NO: 135 - DNA, 60 bp, Vaccinia Virus
ttccttttcgttgatctctcatagatttagaaataaattcttgcgatcctccaaaaggag

SEQ ID NO: 136 - DNA, 81 bp, Vaccinia Virus
attggaattataatataggtgtatttgcgcactcgcgacggttgatgcatcggtaaatatagctgtatctaatgttctagt

SEQ ID NO: 137 - DNA, 66 bp, Vaccinia Virus
gtatatcatcagctgaaaaactatgttttacacgtattccttcggcatttctttttaatgatatat

SEQ ID NO: 138 - DNA, 98 bp, Vaccinia Virus
acaactatgccttttagattatctcctaatttataacacggccgtatacacttggaatacttgtacaatctaagataaactaaatctcgcaaagttgt

SEQ ID NO: 139 - DNA, 70 bp, Vaccinia Virus
ggattttagaatttccaaattcaccagcgatttatcggttttggtgaaatccaaggatttattaatgtcc

SEQ ID NO: 140 - DNA, 88 bp, Vaccinia Virus
atggtcgaagtatagcaggacattgatgctctagaccgtgtataacaaaatctacaaatttttcatccgctatattttgtttcactat

SEQ ID NO: 141 - DNA, 100 bp, Vaccinia Virus
ggtgttaatccactatatgtttctgtagcggctgataacacagcatccaactgagcatccgcgtccgcagagcacatatttttaacagtgaggttacatc

SEQ ID NO: 142 - DNA, 84 bp, Vaccinia Virus
gttagcaagaaattaacattggcattcgaacactctggatcccaacattctcgaggttccgcatattttaatgactcttctaac

SEQ ID NO: 143 - DNA, 76 bp, Vaccinia Virus
tcagtgggtactcccggaggcggatcccgtttagggagctcaacacttactccgccacccatatttatctcattga

SEQ ID NO: 144 - DNA, 69 bp, Vaccinia Virus
acacgactgtggtagatttgttctatagagccggttgccgcaaatagatagaactaccaatatgtctgt

SEQ ID NO: 145 - DNA, 78 bp, Vaccinia Virus
acagtttgaaaaataacagtatcatttaaacatttaacttgcggggttaatttcacaactttactgtttttaagctgt

SEQ ID NO: 146 - DNA, 130 bp, Vaccinia Virus
ccacctgttttaacatataataggcaggagatagatatccgtcattgcaatattccttttcgtaggcacacaatctaatattgataaaatctccattctcttctctgcatttattatcttgtttcggtgg

SEQ ID NO: 147 - DNA, 83 bp, Vaccinia Virus
tactttttctttaccttgagaatatccatcgtttgcttggtcaatagcgatatgtgattttttatcaaccactcgaaaaagta

SEQ ID NO: 148 - DNA, 75 bp, Vaccinia Virus
tagtactagactgacttctaacaaacatctcacctgccataaataaatgcttgatattaaagtcttctatttcta

SEQ ID NO: 149 - DNA, 60 bp, Vaccinia Virus
aaattattcttatcatgcgtccatagtcccgttccgtatctattatcgttagaatatttt

SEQ ID NO: 150 - DNA, 87 bp, Vaccinia Virus
acatccatttttaagtattatattaaaatttaatcaatgtttatttttagttttttagataaaaaatataatattatgagtcgatgt

SEQ ID NO: 151 - DNA, 92 bp, Vaccinia Virus
attttattaccgtgtgggatataaaagtccttgatccattgatctggaaacgggcatctccatttaagactagatgccacggggtttaaaat

SEQ ID NO: 152 - DNA, 62 bp, Vaccinia Virus
ctatcggtttactatttattgataacgcagatgtttgagttgtcatccatggtaatccatag

SEQ ID NO: 153 - DNA, 105 bp, Vaccinia Virus
gtacatgtgaaaatagtcatattcctgattaggataatcaaagttaacaactactttgttacggacgatcttattaaggtagtacatctttttttcataatttac

SEQ ID NO: 154 - DNA, 65 bp, Vaccinia Virus
tgaagaacatatttaattcagatctaaaaaatacatatattagaatgaatacaacgaatacttca

SEQ ID NO: 155 - DNA, 130 bp, Vaccinia Virus
cagctacttctacccaatcaccaggcaataaatgtattttatttttaataaactttccttggcgtattcttgttaattggtttaatcgtttattaaagtaaaatttaacttggtttgacgctaatagttg

SEQ ID NO: 156 - DNA, 70 bp, Vaccinia Virus
ttgcaagtttctgtttctgagagtaaacgaatccctgttttattttattccacagagcactaatttccaa

SEQ ID NO: 157 - DNA, 76 bp, Vaccinia Virus
ccgcttctatttactcccgcagcacaatgaaccaacacgggctcgtttcgttgatcacatttagataaaaaggcgg

SEQ ID NO: 158 - DNA, 78 bp, Vaccinia Virus
gttaggcaatgtatatttatccatcgtcaaatttaaaacatatttgaacttaacttcagatgatggtgcatccatagc

SEQ ID NO: 159 - DNA, 64 bp, Vaccinia Virus
actttttatgaagagccgcgtttaacaatgctttattgtctccgaacgtagctctcttaagagt

SEQ ID NO: 160 - DNA, 64 bp, Vaccinia Virus
tcgtcatatcccgtatagtcagagataggaatcttgaatttactaatcttgcccttgttggcgg

SEQ ID NO: 161 - DNA, 60 bp, Vaccinia Virus
cgcctaatagcttgcggcagatatgttttcttatccaatcgcatagctataaaataggcg

SEQ ID NO: 162 - DNA, 63 bp, Vaccinia Virus
gcgcactaattgccaatataataacaaagaatataagtgttgatgttttggctgcttgtacgc

SEQ ID NO: 163 - DNA, 74 bp, Vaccinia Virus
aatacgagttatattttcgtctatccattgtttcacatttacatatttcgacaaaaagatataaaatgcgtatt

SEQ ID NO: 164 - DNA, 75 bp, Vaccinia Virus
gccgatctctgaatggatactagttttctaagttctaatgtgattctctgaaaatgtaaatccaattcctccggc

SEQ ID NO: 165 - DNA, 70 bp, Vaccinia Virus
gcggtataattagtttttttctctcaatttctatttttagatgtgatggaaaaatgactaattttgtagc

SEQ ID NO: 166 - DNA, 70 bp, Vaccinia Virus
gtggaaacgataactgtatttttaatcacgtcagcggcatctaaattaaatataggtatatttattccac

SEQ ID NO: 167 - DNA, 72 bp, Vaccinia Virus
aaattcatgtgaaactttgtcctttcctacaaacttgataactatttcatcgggacttatttctatgtgttt

SEQ ID NO: 168 - DNA, 92 bp, Vaccinia Virus
aattgttcggctatactcgatgcgtgagtcttgcattcatctccagatatcggagtgagggtcagatccaaatattgagaagccttataatt

SEQ ID NO: 169 - DNA, 62 bp, Vaccinia Virus
accgtcgatactgcagagattctagtaataattttcttaagatctttaacgatattgtcggt

SEQ ID NO: 170 - DNA, 68 bp, Vaccinia Virus
aggagatggagaatttttttcagttgtttgatgatattcctctataactacttcttcttccacttcct

SEQ ID NO: 171 - DNA, 120 bp, Vaccinia Virus
ggagaaagaattacattctctggagaagccataaatatatgacgtgatagagtcgtcaattcctttattagttcatcatatggaactttttcattgtctctaggtgtgaattctatttcc

SEQ ID NO: 172 - DNA, 87 bp, Vaccinia Virus
ggataagttattcatgacggtagcataatgtctcggatgaaaagaataatggatagcaaactgccagtcgatgatattaaactttcc

SEQ ID NO: 173 - DNA, 61 bp, Vaccinia Virus
gtatttctttgacttgaatactatccgatcacaaatatccactagtttagattcaacatac

SEQ ID NO: 174 - DNA, 61 bp, Vaccinia Virus
gttatctatagcatctactaactgtacattttttacatctagaccatgtaccttagataat

SEQ ID NO: 175 - DNA, 120 bp, Vaccinia Virus
tcctttaccatttctaaaatagtcgttgccatgtaagctctttttgaaattgatggagtatgacctaccacttcagcagtttgtttgatagttaacgctattaacttttttggtgacgga

SEQ ID NO: 176 - DNA, 88 bp, Vaccinia Virus
tagtggcttctaatcagatgttctaataaatattttaaaaatgaatcttgattaaaaatcatatcattgaccatttgtctggctactg

SEQ ID NO: 177 - DNA, 87 bp, Vaccinia Virus
ttgattttctttctaatactatatatttctctcgaagaagttcttgcacatcatctgggaataaaatactactgttgagtaaatcag

SEQ ID NO: 178 - DNA, 67 bp, Vaccinia Virus
aggtatcggtctctactgaatctactaacatgtctcgtatgttagcttctacagtctttcgtttcct

SEQ ID NO: 179 - DNA, 65 bp, Vaccinia Virus
cgtcattattttcagcagcctctctaccagaaggttgagaaaagtgtgttctgaatcgcacgacg

SEQ ID NO: 180 - DNA, 111 bp, Vaccinia Virus
gggtgtaggatatagtttcataataggaacatgatattttttgtaccatttcaccaacaagtatagaaatgcaaatctatatctattattttgtattttaccatctaaccc

SEQ ID NO: 181 - DNA, 120 bp, Vaccinia Virus
gaatagttacatttgattcatcttcgatgtttaatgttcctctgactatatccccaacgtgataatacgcgtaggttattacacacggaacgtttataactacagaattattaactattt

SEQ ID NO: 182 - DNA, 89 bp, Vaccinia Virus
gctaccaaggcgaacaacaaagcgattattgttttacctgatcccataatatggaacaataacacgcttctgttctcatctatgatagt

SEQ ID NO: 183 - DNA, 81 bp, Vaccinia Virus
tcaggcatttcgtaatatgatattcttcctttaagcaaatccttaagtacattcacacctcgttcgttaagaagtgtctga

SEQ ID NO: 184 - DNA, 67 bp, Vaccinia Virus
aagaatatagaaataatgataagtccatcatcgtgtttttttgcctcttcataagaactatattttt

SEQ ID NO: 185 - DNA, 60 bp, Vaccinia Virus
cttgatagttgttcctagatatgtaaaataatccaacgtactaggtagcaaattgtctag

SEQ ID NO: 186 - DNA, 102 bp, Vaccinia Virus
taatatacttgcgtgtcgtcgttcaatttatacggatttctatagttctctgttatataatacggttttccatcatgattagacgacgacaatagtgttcta

SEQ ID NO: 187 - DNA, 82 bp, Vaccinia Virus
gcggacacggatactcgtttatgacaccataggcattggttaacgaatgccgtgagtgtaataatttgagagtcatcctcgc

SEQ ID NO: 188 - DNA, 91 bp, Vaccinia Virus
tttcctgtttggacaaataattggaataattcagaaataatcgtttctttctaaacatgtttctagttctaattatttcagaatagagaaa

SEQ ID NO: 189 - DNA, 62 bp, Vaccinia Virus
cgggattgtccggcatatcatgtagatagttaccgtctacatcgtatactcgaccatctacg

SEQ ID NO: 190 - DNA, 71 bp, Vaccinia Virus
gccattataaagtgcacgtttacatatctacgttctggaggagtaagaacgtgactattgagacgaatggc

SEQ ID NO: 191 - DNA, 65 bp, Vaccinia Virus
gctcttgaaaccaaggttttccaaccggactcattgtcgatcggtgagaagtctttttcattagc

SEQ ID NO: 192 - DNA, 110 bp, Vaccinia Virus
aattcagtaaatagagagatatcagccgcactagcatcccctttcaatagttctccctttttaaaggtatctaatgcggatttagaaaactctctatttcttaatgaatt

SEQ ID NO: 193 - DNA, 63 bp, Vaccinia Virus
gaacgtaaacgtagtagccatacgtctcagaattctaaatgatgatatacctgtttttatttc

SEQ ID NO: 194 - DNA, 83 bp, Vaccinia Virus
tattaacgtatcgcattaatactgttttcttagcgaatgatgcagacccttctacgtcatcaaaaatagaaaactcgttatta

SEQ ID NO: 195 - DNA, 61 bp, Vaccinia Virus
tcaaagactagacatttaccatgggatgctaatattcccaaacatacatctataaatttga

SEQ ID NO: 196 - DNA, 75 bp, Vaccinia Virus
atgtatagattgttttcagtgagatgattattagatttaatagcatctcgttcacgtttgaacagtttattgcgt

SEQ ID NO: 197 - DNA, 83 bp, Vaccinia Virus
taatgacgcatattctactcttggaattaatagttttgatattagtaaaaaatttatttctaaaattttgatcatcgtaatta

SEQ ID NO: 198 - DNA, 63 bp, Vaccinia Virus
taatggcggaaaactttttagaaatgttatatataaaagaattttttcgtgttccaaacatta

SEQ ID NO: 199 - DNA, 81 bp, Vaccinia Virus
tatataatctttttcatcttgtgagtaccctggatacgaaataaatttattatccgtatttccataataaggtttagtata

SEQ ID NO: 200 - DNA, 67 bp, Vaccinia Virus
agatactataccgttgtgtctacaaccgctacataatcgtagattcatgttaacactctacgtatct

SEQ ID NO: 201 - DNA, 77 bp, Vaccinia Virus
agcgagtgcttcttctttagcgggcttaaagactgctttaggtgctgaaataaccacatctggaaggcttactcgct

SEQ ID NO: 202 - DNA, 61 bp, Vaccinia Virus
gaagagatagatacgtgattaatacatttatatccaacatatggtacgtaaccgaatcttc

SEQ ID NO: 203 - DNA, 64 bp, Vaccinia Virus
tgtcttagaaggagtgttttcttggcaaaagaataccaagtgcttaaatatttctactacttca

SEQ ID NO: 204 - DNA, 71 bp, Vaccinia Virus
tactgaatccgcctaagcgtgttcttctgcatgtgcggataatttaactactatattggcggaggacggta

SEQ ID NO: 205 - DNA, 80 bp, Vaccinia Virus
aatatttagtttattcataatgttaagcatatcctgaatagtaaagttagatgtgtcatacttgttagtagttagatatt

SEQ ID NO: 206 - DNA, 90 bp, Vaccinia Virus
aggatgagtacatttcacagaaacactagcattgttcaatgtgctctttacatgggtaaggagttgaaatagctcgtttctatttgttct

SEQ ID NO: 207 - DNA, 72 bp, Vaccinia Virus
gatggcggcgtcgtcgttttttgatctttattaaatttagagataatatcctgaacagcattgctcggcgtc

SEQ ID NO: 208 - DNA, 83 bp, Vaccinia Virus
gttatagctttctgctattatacccgctatttcaaatagacttatacgtctagtatagcgtcgtttaagagcagatatatgat

SEQ ID NO: 209 - DNA, 80 bp, Vaccinia Virus
gtttttgaagtttccaaattttgataatatagtctagatggaattttagaccatctttgtcaaaatcgtttaccgacaac

SEQ ID NO: 210 - DNA, 63 bp, Vaccinia Virus
aggatctagataattaataatgatgggttttctattcttattctttgtattttggcatatcct

SEQ ID NO: 211 - DNA, 111 bp, Vaccinia Virus
cagagttgggatagtatttttctaacgtcggtattatattattaggatctacgttcatatgtatcataatattaatcatccacgttttgataaatctatctttagcttctg

SEQ ID NO: 212 - DNA, 67 bp, Vaccinia Virus
cgtataaattttagaaataacattagcgaattgttgtgcattgatgtcgttattctgaaacagtatg

SEQ ID NO: 213 - DNA, 84 bp, Vaccinia Virus
tagagttaagagagattagagtttgtacattaagcaacatgtctctaaatgtggctacaaacttttccttttccacatcatcta

SEQ ID NO: 214 - DNA, 68 bp, Vaccinia Virus
gagtcattcgaagcgtcaatagaatatgtctcttaactatttccggctgttgtatatttaaatgactt

SEQ ID NO: 215 - DNA, 104 bp, Vaccinia Virus
gacttgactagatcgtcagtagtaatttgtgcatcgtctattctgcatccgcttcgtcgaataatgtatagcatcgctttgagattctccatagctatcaagtc

SEQ ID NO: 216 - DNA, 91 bp, Vaccinia Virus
ataatagtggccggagaatcatcatctggaaatagatcttcattaagttgtgaggatatttcctctggagatgacactacggcggcattat

SEQ ID NO: 217 - DNA, 93 bp, Vaccinia Virus
gataatgtttatgacaataataatcacgttagtgacgataatttttcgttttctactttcgtgatattgtttaatcgttttatagattctatc

SEQ ID NO: 218 - DNA, 67 bp, Vaccinia Virus
gttgttgacgttgttccgatatcaataactctctacgaaacgtaggaggtggagtatcgtcaataat

SEQ ID NO: 219 - DNA, 116 bp, Vaccinia Virus
tagtattctggtaaaattatctaaattatcagatgattttgtattagatcgttgatttctaagattaaccacttcatcctccaacatctgaattcttttatctttatcataaacta

SEQ ID NO: 220 - DNA, 62 bp, Vaccinia Virus
ataaagtcttggtatgactcctttctaatatagtacggactacctttgtcacccaactttat

SEQ ID NO: 221 - DNA, 87 bp, Vaccinia Virus
gctgaagtaattaatttttctgcctcgtttttactacaactagttttcatcaatgtagtgacgatgtattgtttagttactcttggt

SEQ ID NO: 222 - DNA, 92 bp, Vaccinia Virus
gggtattaataatatctatatttccagcgttaagtgtaacattaaacagttttaattcacgtgacgtggtatcaattaaataattaatgccc

SEQ ID NO: 223 - DNA, 101 bp, Vaccinia Virus
gttctagtacaattagacgtaagttctgcttgggaattttttaacgctaaagagttaacgttaatcgtgcacccaacgtatttacatctagttctttgaac

SEQ ID NO: 224 - DNA, 65 bp, Vaccinia Virus
tgattttggtttacatgtaatacattttgaactctttgattttgtatcacatgcgccggcagtca

SEQ ID NO: 225 - DNA, 125 bp, Vaccinia Virus
actactatttaattttaccatatcttcgaaaacaaaaatagatattatttttgcagtacaaactattgtttttatatggtttatattccactttgttcattcggcgatttaaaatttttattagt

SEQ ID NO: 226 - DNA, 61 bp, Vaccinia Virus
gaagagtaatgtatagaggacgttttgattcgatcattttcctcatattagaaactacttc

SEQ ID NO: 227 - DNA, 85 bp, Vaccinia Virus
tcctagtttatctacagacagactaataattcgttgcatgaaatttcctatcatgtactttatttctttgatggatgtgctagga

SEQ ID NO: 228 - DNA, 71 bp, Vaccinia Virus
aaagaattatacttttctatagccgcagaatctgaaaatctcaaacttttgtacagactaagtaattcttt

SEQ ID NO: 229 - DNA, 61 bp, Vaccinia Virus
aagtaaagatattgacttggatggtattttctgacagaaaacatctttgaaatctttactt

SEQ ID NO: 230 - DNA, 74 bp, Vaccinia Virus
ccgttataaatgtctttgtcgatgatatattcaacgcttccaattgtgatatatccagagatatcttgtaatgg

SEQ ID NO: 231 - DNA, 73 bp, Vaccinia Virus
tcatctaatgccgtagccgtaagtacgtggtttacaacattagctacttctttaaagtactcgttttggatga

SEQ ID NO: 232 - DNA, 64 bp, Vaccinia Virus
tgtgattgattcccactaatgaagatgccacatatccatctctaaattcggcaggaaagtcaca

SEQ ID NO: 233 - DNA, 70 bp, Vaccinia Virus
aatgctcgcaacattaacatcttgaaccgttggtacaattccgttccataaatttataatgttcgccatt

SEQ ID NO: 234 - DNA, 78 bp, Vaccinia Virus
atggagattttctattctcgtccattttaggatatgctttcataaagtccctaataacttcgtgaataatgtttctat

SEQ ID NO: 235 - DNA, 65 bp, Vaccinia Virus
tctttttagccagagatatcatagccgctcttagagtttcagcgtgattttccaacctaaataga

SEQ ID NO: 236 - DNA, 69 bp, Vaccinia Virus
ttgcttcgcgtttagcctctggctttttatcagcctttgtagaaaaaaattcagttgctggaattgcaa

SEQ ID NO: 237 - DNA, 99 bp, Vaccinia Virus
acaccagaaaagacggcttgagatcaactttatctaatggtttataaaacgaaggaggccttcgttcgaaatctaatttgacttttacgcctctggcgt

SEQ ID NO: 238 - DNA, 113 bp, Vaccinia Virus
tgtgagaagtttgcctcgttaaggtcttccatttaaatattatataaacatttgtgtttgtatcttattcgtcttttatggaatagttttttactagtaaagctgcaattaca

SEQ ID NO: 239 - DNA, 66 bp, Vaccinia Virus
atagatgccatgttaaaaatgtccgccgtcgactttttggaacgattgataaaagctggtgtttat

SEQ ID NO: 240 - DNA, 64 bp, Vaccinia Virus
atagcatcatctttagatcattaattgttaccttccccaatacaaccaaatcatcatgatatat

SEQ ID NO: 241 - DNA, 130 bp, Vaccinia Virus
ctttggcttataaaatacaaatgacattcccttatgtttaatcttaatcttttctttagttattgaatcgttacaattataaaatgatgttttttccaaaaacctaagtgtatttaaaatagatgccatg

SEQ ID NO: 242 - DNA, 75 bp, Vaccinia Virus
tacgacactgataaaccgcattatctgtggacattttaatgttggtatctagataacaatgtttatcgtattgta

SEQ ID NO: 243 - DNA, 73 bp, Vaccinia Virus
tgtatcctcaacataatcaatgagccaggtaatcaagacatcggatttattgggtagtgttgatgattccgca

SEQ ID NO: 244 - DNA, 120 bp, Vaccinia Virus
gatttggccaaatgtatccatcataatctgggttataaacgggtgtaaacaagaatatatgtttatattttttaactagtgtagaaaacagagatagtaaatagatagtttttccagatc

SEQ ID NO: 245 - DNA, 62 bp, Vaccinia Virus
agcgaagctatcatcgtccaatatctcattcctagaaatattatctacgtcattgttttgtt

SEQ ID NO: 246 - DNA, 87 bp, Vaccinia Virus
gtggtattatactcatgcctagtaatagtctctttgcgttgacggaaagcagactagaaataacaggctaaaatgttcagacaccat

SEQ ID NO: 247 - DNA, 74 bp, Vaccinia Virus
ggcaaataattaatcagtgatagattgtttacatacagtatgtcgtttgtaaacgatgttaccaatcgtttgct

SEQ ID NO: 248 - DNA, 68 bp, Vaccinia Virus
ggaattttgacaattctctttgagccgatagtatcagtgaaaagaatgtaaactttgtcataagtacc

SEQ ID NO: 249 - DNA, 62 bp, Vaccinia Virus
atattacgcagcaagcataaccagcataatctgtcttaggtttgttcattgtcgtgtggtgt

SEQ ID NO: 250 - DNA, 123 bp, Vaccinia Virus
gataaaaatgtagtgtaattgttatatagtgtaacacgaatgcagtttgggagtattcgttgtgctacaaatatatttccattcttcgtggcatttttagctataaaattatatggggttgtc

SEQ ID NO: 251 - DNA, 73 bp, Vaccinia Virus
ttttatcgttttatctattgatggtgtatgaactaatttacgttctacaacttttaatagtgtcgctgtaaaa

SEQ ID NO: 252 - DNA, 84 bp, Vaccinia Virus
tattggattgtatattttattttatattttatattttatattttgtaataagaataaaatgctaatgtcaagtttattccaata

SEQ ID NO: 253 - DNA, 70 bp, Vaccinia Virus
tgttaattttactagatcgtcatgggtcatagaatttataggttccgtagtccatggatccaaactagca

SEQ ID NO: 254 - DNA, 82 bp, Vaccinia Virus
ggagtattccaagagttttagttgtctagtatttaacaagagaagagatttcaacagactgtttatgaactcgaatgccgcc

SEQ ID NO: 255 - DNA, 103 bp, Vaccinia Virus
gttttctaaagatgtcattaaaccctcgatcatgaatggatttatcatcatcgtttttatgttggacatgagcttagtccgtttgtccacatctatagacgac

SEQ ID NO: 256 - DNA, 70 bp, Vaccinia Virus
tcggatgaccatatatttattttcagttttattatacgcataaattgtaaaaaatatgttaggtttacga

SEQ ID NO: 257 - DNA, 64 bp, Vaccinia Virus
tataaggtgattggaatgggataaatacaacaattatattttttatcatatccttcacgctata

SEQ ID NO: 258 - DNA, 72 bp, Vaccinia Virus
attcgcgaagcgacgtcatttaataaaaaaagtatttttttttaatatttttcacaaatatcgttcgcggat

SEQ ID NO: 259 - DNA, 90 bp, Vaccinia Virus
tatcttggcaataactaattgagatattgatgcgagttcggtatgcatatcggacacgtatccgagtactgattccaagttgccagagta

SEQ ID NO: 260 - DNA, 80 bp, Vaccinia Virus
atagatatgataacaggaataacatctttaggtttaaaataattatatacaccagtaggagtcttgtcatcgtcatctat

SEQ ID NO: 261 - DNA, 75 bp, Vaccinia Virus
gagtcgtccatattttattctgaggcctaatagacctctgtacataaaatattcctctagaatagtagacatctc

SEQ ID NO: 262 - DNA, 105 bp, Vaccinia Virus
ggatattcttgatacattctttttatacagtgaattgcatacatccgatacagcattatccatatatggcaaatctgcaatcactgtattgtttttagattgtcc

SEQ ID NO: 263 - DNA, 62 bp, Vaccinia Virus
gtagtcaccgtaaatttatcaccagaaatactaatatctatctttatgtccatggtgatcac

SEQ ID NO: 264 - DNA, 105 bp, Vaccinia Virus
tatctatcagattattatgtgttataaggtactttttctcataataaactagagtatgagtaagatagtgtttttcaaaacatataaatctaaaattgatggatg

SEQ ID NO: 265 - DNA, 102 bp, Vaccinia Virus
aaagtattggtaatcgtgtcatattagtataaaaagtgatttatttttacaaaattatgtattttgttctatcaactacctataaaactttccaaatacttt

SEQ ID NO: 266 - DNA, 82 bp, Vaccinia Virus
atggcagatccaatttgtaaaaaatcagcggttgaaagaatatatttcacgttatcgttagttaggctcaaaggtatcccat

SEQ ID NO: 267 - DNA, 67 bp, Vaccinia Virus
cgtgaagatatcatttcccatgtattttttttatgattgtagcagtttatggaaattttatcacgcg

SEQ ID NO: 268 - DNA, 77 bp, Vaccinia Virus
cttggtataattatcaaaatacaagacgtcgcttttagcagctaaaagaataatggaattgggctccttataccaag

SEQ ID NO: 269 - DNA, 72 bp, Vaccinia Virus
taccttatcaaatgatcctgttgggcattttctacattgatgacatccattagaataattgggattgtggta

SEQ ID NO: 270 - DNA, 64 bp, Vaccinia Virus
tcgctacttggttagtgtattattcagtatgaagacctattaataattacttatcttttgacga

SEQ ID NO: 271 - DNA, 71 bp, Vaccinia Virus
ttttggtaatctattattattggctctgatcaccgcatctagatctacacctaatctattaattaccaaga

SEQ ID NO: 272 - DNA, 78 bp, Vaccinia Virus
tttggtcgatgtaaaatttttgtcgataaaaattaaaaaataacttaatttattattgatctcgtgtgtacaaccgaa

SEQ ID NO: 273 - DNA, 70 bp, Vaccinia Virus
gattctcgtcgtacccaccgagagcgtgtgcgtaaaacatcgccatgatttcggttgtacacacgagatc

SEQ ID NO: 274 - DNA, 60 bp, Vaccinia Virus
cgtattatacgcattataactgacagcgtcgtaaatagatgtttcgttgtatatagtacg

SEQ ID NO: 275 - DNA, 102 bp, Vaccinia Virus
ggtagcaatttatggaacttatattggtcattatttttgtcacaggaacaaactaatactataacggagattaaaaatatgacgcccataattgttaacgcc

SEQ ID NO: 276 - DNA, 90 bp, Vaccinia Virus
gtatcataattttcaaagatggtcgtttagacaatagtacttccattattattttgttgttgtttgcgactgcttccgaaatacatgtac

SEQ ID NO: 277 - DNA, 60 bp, Vaccinia Virus
tgttctctatagttacattaattaaaattttatatgtgacacccattcatctggagaata

SEQ ID NO: 278 - DNA, 111 bp, Vaccinia Virus
catcttttaccaacacaaagggtggatatttgttcattggagttgataataatacacacaaagtatttggattcacggtgggttacgactacctcagactggtagagaatg

SEQ ID NO: 279 - DNA, 64 bp, Vaccinia Virus
gtacgcgtgtcgattcatcaaggtatataaacctggggatgaggctacctcgacatacgtgtgc

SEQ ID NO: 280 - DNA, 62 bp, Vaccinia Virus
taattttttataaactaacattgttaattgaaaagggataacatgttacagaatataaatta

SEQ ID NO: 281 - DNA, 77 bp, Vaccinia Virus
aacacggcagaatatcgcccatatactttatttatggatttgaatgagatattctgagcgctaaccttatccgtgtt

SEQ ID NO: 282 - DNA, 107 bp, Vaccinia Virus
agtagcatacggatgctcgatgtacaaattgatatggtcgtcgtattcagtcaatgttacagtcggtggtccaatttttacttcgacgcatagtcccgtacaatact

SEQ ID NO: 283 - DNA, 98 bp, Vaccinia Virus
ccctattttcaatccccatgtttcctcttcagtcttctcacatcgtctaatagacatggagtagatgatagaggggaacagaaggactataatcaggg

SEQ ID NO: 284 - DNA, 87 bp, Vaccinia Virus
gaaaagacgtgggtactaaagttggctgtcatcttaccaattgcaattggaagaacaacgacctgcactaataccacatgttttttc

SEQ ID NO: 285 - DNA, 60 bp, Vaccinia Virus
gtcgttaaaagcgcttctatatctctcattagctagaattatagatacgctattaattat

SEQ ID NO: 286 - DNA, 60 bp, Vaccinia Virus
tggtcgtgtagcgcgatagagatagtctaatattaatattagatatccgtaacactacca

SEQ ID NO: 287 - DNA, 64 bp, Vaccinia Virus
gacatggtaagattactggctcgttttctaactccatgaatgatgcaaaatattaccctttgtc

SEQ ID NO: 288 - DNA, 91 bp, Vaccinia Virus
aagggtggaatgcgatacattgatctatgtagttttaaaacacacgcaaactttgaagaatttatataaatcattccatcgatacatcctt

SEQ ID NO: 289 - DNA, 73 bp, Vaccinia Virus; identical to SEQ ID NO: 44

SEQ ID NO: 290 - DNA, 74 bp, Vaccinia Virus
ataattcagtaataataattcagtaatgtatataaaaatgcattgtatatttactccaatactactgtagttgt

SEQ ID NO: 291 - DNA, 76 bp, Vaccinia Virus
atagagtctacatttatatgttctctatcggtgagatacaaatacctagatagtcgcgtatcttcatccattctat

SEQ ID NO: 292 - DNA, 60 bp, Vaccinia Virus
atatcttcagtacatcgtttgtaaagtaattattatacaaatagcagtgtagtgcagtat

SEQ ID NO: 293 - DNA, 130 bp, Vaccinia Virus
attgcacgaagttcttcggcggttttcatggagtcatttctgatgaaacatttaatgatctccacgcaattgtcgatattgtcccacggaagtgaatccttcaactcaccaccaaagagctccgttgcat

SEQ ID NO: 294 - DNA, 73 bp, Vaccinia Virus
ccacatcctttattaataataatttaacaatctctatatctatggttgagaaagaccagtagtattggatggg

SEQ ID NO: 295 - DNA, 66 bp, Vaccinia Virus
gaaggtagtaatgttagtagacaatttttatctgtgaaaacaggaaatagtttatcatataccttt

SEQ ID NO: 296 - DNA, 67 bp, Vaccinia Virus; identical to SEQ ID NO: 46

SEQ ID NO: 297 - DNA, 82 bp, Vaccinia Virus
ggccttttttatcgttatcggttttctacactcacctggtttataaacgtgtgcgagacacaaataataataatgtaacgct

SEQ ID NO: 298 - DNA, 89 bp, Vaccinia Virus
tcataatattagaatatattttaaaggacttatcgttattatatttttttaactcggtgaggtatcttcttaactttctcgaattatga

SEQ ID NO: 299 - DNA, 65 bp, Vaccinia Virus
ttctgaaagagatgagaagcctgtagagagaccctgcgctttctctatgggtccatctatgagaa

SEQ ID NO: 300 - DNA, 75 bp, Vaccinia Virus; identical to SEQ ID NO: 54

SEQ ID NO: 301 - DNA, 102 bp, Vaccinia Virus
tttttataaacatgaaaccactgtctaaatgtaattatgatcttgatttatagatgaagatcagcctttagaggattttaaccagtatgtttaatatgaaaa

SEQ ID NO: 302 - DNA, 126 bp, Vaccinia Virus; identical to SEQ ID NO: 37

SEQ ID NO: 303 - DNA, 72 bp, Vaccinia Virus; identical to SEQ ID NO: 38

SEQ ID NO: 304 - DNA, 79 bp, Vaccinia Virus; identical to SEQ ID NO: 39

SEQ ID NO: 305 - DNA, 79 bp, Vaccinia Virus; identical to SEQ ID NO: 40

SEQ ID NO: 306 - DNA, 123 bp, Vaccinia Virus; identical to SEQ ID NO: 1

SEQ ID NO: 307 - DNA, 124 bp, Vaccinia Virus; identical to SEQ ID NO: 2

SEQ ID NO: 308 - DNA, 124 bp, Vaccinia Virus; identical to SEQ ID NO: 2

SEQ ID NO: 309 - DNA, 124 bp, Vaccinia Virus; identical to SEQ ID NO: 2

SEQ ID NO: 310 - DNA, 124 bp, Vaccinia Virus; identical to SEQ ID NO: 2

SEQ ID NO: 311 - DNA, 124 bp, Vaccinia Virus; identical to SEQ ID NO: 2

SEQ ID NO: 312 - DNA, 124 bp, Vaccinia Virus; identical to SEQ ID NO: 2

SEQ ID NO: 313 - DNA, 124 bp, Vaccinia Virus; identical to SEQ ID NO: 2

SEQ ID NO: 314 - DNA, 124 bp, Vaccinia Virus; identical to SEQ ID NO: 2

SEQ ID NO: 315 - DNA, 124 bp, Vaccinia Virus; identical to SEQ ID NO: 2

SEQ ID NO: 316 - DNA, 124 bp, Vaccinia Virus; identical to SEQ ID NO: 2

SEQ ID NO: 317 - DNA, 122 bp, Vaccinia Virus; identical to SEQ ID NO: 12

SEQ ID NO: 318 - DNA, 78 bp, Vaccinia Virus
attaattataaaattatgtatatgatttactaactttagttagataagttagtaatacataaattttagtatattaat

SEQ ID NO: 319 - DNA, 100 bp, Vaccinia Virus; identical to SEQ ID NO: 13

SEQ ID NO: 320 - DNA, 100 bp, Vaccinia Virus; identical to SEQ ID NO: 13

SEQ ID NO: 321 - DNA, 100 bp, Vaccinia Virus; identical to SEQ ID NO: 13

SEQ ID NO: 322 - DNA, 101 bp, Vaccinia Virus; identical to SEQ ID NO: 15

SEQ ID NO: 323 - DNA, 115 bp, Vaccinia Virus; identical to SEQ ID NO: 16

SEQ ID NO: 324 - DNA, 96 bp, Vaccinia Virus; identical to SEQ ID NO: 17

SEQ ID NO: 325 - DNA, 130 bp, Vaccinia Virus; identical to SEQ ID NO: 18

SEQ ID NO: 326 - DNA, 91 bp, Vaccinia Virus; identical to SEQ ID NO: 20

SEQ ID NO: 327 - DNA, 96 bp, Vaccinia Virus; identical to SEQ ID NO: 21

SEQ ID NO: 328 - DNA, 70 bp, Vaccinia Virus; identical to SEQ ID NO: 22

SEQ ID NO: 329 - DNA, 70 bp, Vaccinia Virus; identical to SEQ ID NO: 22

SEQ ID NO: 330 - DNA, 61 bp, Vaccinia Virus; identical to SEQ ID NO: 24

SEQ ID NO: 331 - DNA, 128 bp, Vaccinia Virus; identical to SEQ ID NO: 25

SEQ ID NO: 332 - DNA, 128 bp, Vaccinia Virus; identical to SEQ ID NO: 25

SEQ ID NO: 333 - DNA, 128 bp, Vaccinia Virus; identical to SEQ ID NO: 25

SEQ ID NO: 334 - DNA, 128 bp, Vaccinia Virus; identical to SEQ ID NO: 25

SEQ ID NO: 335 - DNA, 128 bp, Vaccinia Virus; identical to SEQ ID NO: 25

SEQ ID NO: 336 - DNA, 128 bp, Vaccinia Virus; identical to SEQ ID NO: 25

SEQ ID NO: 337 - DNA, 128 bp, Vaccinia Virus; identical to SEQ ID NO: 25

SEQ ID NO: 338 - DNA, 126 bp, Vaccinia Virus; identical to SEQ ID NO: 31

SEQ ID NO: 339 - DNA, 71 bp, Vaccinia Virus; identical to SEQ ID NO: 32

SEQ ID NO: 340 - DNA, 75 bp, Vaccinia Virus; identical to SEQ ID NO: 33

SEQ ID NO: 341 - DNA, 119 bp, Vaccinia Virus
tgagaccatcaaagagagaaagagaataaaaatatttttgtaaaactttttttatgagaccatcaaagagagaaagagaataaaaatatttttgtaaaactttttttatgagaccatca

SEQ ID NO: 342 - DNA, 131 bp, Vaccinia Virus; identical to SEQ ID NO: 35

SEQ ID NO: 343 - DNA, 91 bp, Vaccinia Virus; identical to SEQ ID NO: 36

SEQ ID NO: 344 - DNA, 107 bp, Vaccinia Virus
tcaccttatcaaagtcgtttatatcacattgtatatagtttataaccttaactttcgaggttattggttgtggatcttctacaatatctatgactctgatttcttga

SEQ ID NO: 345 - DNA, 70 bp, Vaccinia Virus
tcggccatacgtttactttttgcgtatacatgtcctggtgatatatcataaagggtatgctcatggccga

SEQ ID NO: 346 - DNA, 62 bp, Vaccinia Virus; identical to SEQ ID NO: 55

SEQ ID NO: 347 - DNA, 63 bp, Vaccinia Virus; identical to SEQ ID NO: 42

SEQ ID NO: 348 - DNA, 73 bp, Vaccinia Virus; identical to SEQ ID NO: 43

SEQ ID NO: 349 - DNA, 102 bp, Vaccinia Virus; identical to SEQ ID NO: 41

SEQ ID NO: 350 - DNA, 24 bp, Vaccinia Virus
tgatggagtcgtaaaaaagtttta

SEQ ID NO: 351 - DNA, 24 bp, Vaccinia Virus
tgatggagtcgtaaaaaagtttta

SEQ ID NO: 352 - DNA, 24 bp, Vaccinia Virus
tgatggagtcgtaaaaaagtttta

SEQ ID NO: 353 - DNA, 24 bp, Vaccinia Virus
tgatggagtcgtaaaaaagtttta

SEQ ID NO: 354 - DNA, 24 bp, Vaccinia Virus
tgatggagtcgtaaaaaagtttta

SEQ ID NO: 355 - DNA, 24 bp, Vaccinia Virus
tgatggagtcgtaaaaaagtttta

SEQ ID NO: 356 - DNA, 24 bp, Vaccinia Virus
tgatggagtcgtaaaaaagtttta

SEQ ID NO: 357 - DNA, 24 bp, Vaccinia Virus
tgatggagtcgtaaaaaagtttta

SEQ ID NO: 358 - DNA, 24 bp, Vaccinia Virus
tgatggagtcgtaaaaaagtttta

SEQ ID NO: 359 - DNA, 24 bp, Vaccinia Virus
tgatggagtcgtaaaaaagtttta

SEQ ID NO: 360 - DNA, 24 bp, Vaccinia Virus
tgatggagtcgtaaaaaagtttta

SEQ ID NO: 361 - DNA, 24 bp, Vaccinia Virus
cgtaaaaaagttttatctttctct

SEQ ID NO: 362 - DNA, 24 bp, Vaccinia Virus
tgatggagtcgtaaaaaagtttta

SEQ ID NO: 363 - DNA, 24 bp, Vaccinia Virus
tgatggagtcgtaaaaaagtttta

SEQ ID NO: 364 - DNA, 24 bp, Vaccinia Virus
tgatggagtcgtaaaaaagtttta

SEQ ID NO: 365 - DNA, 24 bp, Vaccinia Virus
ataaaaaaagttttacaaaaatat

SEQ ID NO: 366 - DNA, 24 bp, Vaccinia Virus
taaaatatttttattctctttctc

SEQ ID NO: 367 - DNA, 24 bp, Vaccinia Virus
tgatggagtcgtaaaaaagtttta

SEQ ID NO: 368 - DNA, 24 bp, Vaccinia Virus
tgatggagtcgtaaaaaagtttta

SEQ ID NO: 369 - DNA, 24 bp, Vaccinia Virus
tctttggtacaaaatttcacacaa

SEQ ID NO: 370 - DNA, 24 bp, Vaccinia Virus
tgagaccatcgaaggagactccat

SEQ ID NO: 371 - DNA, 24 bp, Vaccinia Virus
aatatttttgtaaaacttttttta

SEQ ID NO: 372 - DNA, 24 bp, Vaccinia Virus
aatatttttgtaaaacttttttta

SEQ ID NO: 373 - DNA, 24 bp, Vaccinia Virus
ttatacgatctacgttttattata

SEQ ID NO: 374 - DNA, 24 bp, Vaccinia Virus
catcagaaagaggtttaatatttt

SEQ ID NO: 375 - DNA, 24 bp, Vaccinia Virus
catcagaaagaggtttaatatttt

SEQ ID NO: 376 - DNA, 24 bp, Vaccinia Virus
catcagaaagaggtttaatatttt

SEQ ID NO: 377 - DNA, 24 bp, Vaccinia Virus
catcagaaagaggtttaatatttt

SEQ ID NO: 378 - DNA, 24 bp, Vaccinia Virus
catcagaaagaggtttaatatttt

SEQ ID NO: 379 - DNA, 24 bp, Vaccinia Virus
catcagaaagaggtttaatatttt

SEQ ID NO: 380 - DNA, 24 bp, Vaccinia Virus
catcagaaagaggtttaatatttt

SEQ ID NO: 381 - DNA, 24 bp, Vaccinia Virus
tgaatagagttatcgattcagaca

SEQ ID NO: 382 - DNA, 24 bp, Vaccinia Virus
agaggtttaatatttttgtgagac

SEQ ID NO: 383 - DNA, 24 bp, Vaccinia Virus
agagagaaagagaataaaaatatt

SEQ ID NO: 384 - DNA, 24 bp, Vaccinia Virus
gaagagagaaagagaataaaaata

SEQ ID NO: 385 - DNA, 24 bp, Vaccinia Virus
tcaatgttttaaaatatatggaca

SEQ ID NO: 386 - DNA, 24 bp, Vaccinia Virus
atggttctttccgtacaacatact

SEQ ID NO: 387 - DNA, 24 bp, Vaccinia Virus
tgactcgtcccttaataggcagta

SEQ ID NO: 388 - DNA, 24 bp, Vaccinia Virus
gattgtatcagtttcgtagtcttg

SEQ ID NO: 389 - DNA, 24 bp, Vaccinia Virus
taacatcgattcccatatgatgtt

SEQ ID NO: 390 - DNA, 24 bp, Vaccinia Virus
tgattggagaagtaggaaacagga

SEQ ID NO: 391 - DNA, 24 bp, Vaccinia Virus
tcgattccgtccaagatgataaaa

SEQ ID NO: 392 - DNA, 24 bp, Vaccinia Virus
taatgtcctgtttcatttgtttcc

SEQ ID NO: 393 - DNA, 24 bp, Vaccinia Virus
tgtatgctcctagcggagttaatc

SEQ ID NO: 394 - DNA, 24 bp, Vaccinia Virus
tcatcgggtgtattctcattcata

SEQ ID NO: 395 - DNA, 24 bp, Vaccinia Virus
ttctggtctcggattaggcgtcgt

SEQ ID NO: 396 - DNA, 24 bp, Vaccinia Virus
atcgatcatatctatatcatccat

SEQ ID NO: 397 - DNA, 23 bp, Vaccinia Virus
ttgaagactcttccagagacgat

SEQ ID NO: 398 - DNA, 24 bp, Vaccinia Virus
ttaataatataaaattcccaatct

SEQ ID NO: 399 - DNA, 24 bp, Vaccinia Virus
tggggttactctaaatcgcttgtt

SEQ ID NO: 400 - DNA, 24 bp, Vaccinia Virus
ttagtagcgtggcaatgacagggt

SEQ ID NO: 401 - DNA, 24 bp, Vaccinia Virus
ttaattgtaaatgatattattatt

SEQ ID NO: 402 - DNA, 24 bp, Vaccinia Virus
agataacataccacaccatttttt

SEQ ID NO: 403 - DNA, 24 bp, Vaccinia Virus
ataagtggacatatagatgcagaa

SEQ ID NO: 404 - DNA, 24 bp, Vaccinia Virus
tgatacatgtattaaaatactttc

SEQ ID NO: 405 - DNA, 24 bp, Vaccinia Virus
taaaaattaaacaaatcgttatta

SEQ ID NO: 406 - DNA, 23 bp, Vaccinia Virus
atggattctgtgtttatgctgtt

SEQ ID NO: 407 - DNA, 24 bp, Vaccinia Virus
taatataaactaataatatattgt

SEQ ID NO: 408 - DNA, 24 bp, Vaccinia Virus
tctctagcgtggatacagtcaccg

SEQ ID NO: 409 - DNA, 24 bp, Vaccinia Virus
tatcagtatgtatatctatattaa

SEQ ID NO: 410 - DNA, 24 bp, Vaccinia Virus
tattatacaaaaattttttatttc

SEQ ID NO: 411 - DNA, 19 bp, Vaccinia Virus
tataacatcgtaatcaaaa

SEQ ID NO: 412 - DNA, 24 bp, Vaccinia Virus
atagttagatagaatattcattag

SEQ ID NO: 413 - DNA, 24 bp, Vaccinia Virus
tggtatgttcacgataagtataat

SEQ ID NO: 414 - DNA, 24 bp, Vaccinia Virus
tcttttaagaattgtggatattag

SEQ ID NO: 415 - DNA, 20 bp, Vaccinia Virus
ttctcatcatcagaataaat

SEQ ID NO: 416 - DNA, 24 bp, Vaccinia Virus
ccgctgagtggtaaacaacagaac

SEQ ID NO: 417 - DNA, 24 bp, Vaccinia Virus
cgttagtttaatatcctcagtcat

SEQ ID NO: 418 - DNA, 24 bp, Vaccinia Virus
ttgatgatatctacatcgtttgga

SEQ ID NO: 419 - DNA, 19 bp, Vaccinia Virus
tagctttcactcatatgac

SEQ ID NO: 420 - DNA, 24 bp, Vaccinia Virus
cagaagtaggattatgtaacatca

SEQ ID NO: 421 - DNA, 21 bp, Vaccinia Virus
tatgaagtaaagtatctacga

SEQ ID NO: 422 - DNA, 24 bp, Vaccinia Virus
ccgtttgcatgttaccactatcaa

SEQ ID NO: 423 - DNA, 24 bp, Vaccinia Virus
gctacagttccttgttcgtcgaca

SEQ ID NO: 424 - DNA, 24 bp, Vaccinia Virus
tgcattaatttttgtattgattct

SEQ ID NO: 425 - DNA, 24 bp, Vaccinia Virus
tgttttgcgatagccatgtatcta

SEQ ID NO: 426 - DNA, 24 bp, Vaccinia Virus
taagtttggcagctagcagattca

SEQ ID NO: 427 - DNA, 24 bp, Vaccinia Virus
tcctcctaggatatttgtaatatc

SEQ ID NO: 428 - DNA, 24 bp, Vaccinia Virus
tgagaatactaaaattcctaacga

SEQ ID NO: 429 - DNA, 24 bp, Vaccinia Virus
taatagttaccacgtgctgtacca

SEQ ID NO: 430 - DNA, 24 bp, Vaccinia Virus
tccatagtacatagttgttgcggt

SEQ ID NO: 431 - DNA, 24 bp, Vaccinia Virus
tagtaggactagtatcgtacaatt

SEQ ID NO: 432 - DNA, 19 bp, Vaccinia Virus
tttgtggtattggatagaa

SEQ ID NO: 433 - DNA, 24 bp, Vaccinia Virus
tgacagaccagacctaggagctat

SEQ ID NO: 434 - DNA, 24 bp, Vaccinia Virus
ttgaaattgttttttattttcttg

SEQ ID NO: 435 - DNA, 24 bp, Vaccinia Virus
tccaaaatgatgcctctgcctttt

SEQ ID NO: 436 - DNA, 24 bp, Vaccinia Virus
gtgaatccatctctatgtttcagt

SEQ ID NO: 437 - DNA, 24 bp, Vaccinia Virus
gaagtgattctttgatggtgtcag

SEQ ID NO: 438 - DNA, 24 bp, Vaccinia Virus
tttgttggattcctgattatttac

SEQ ID NO: 439 - DNA, 24 bp, Vaccinia Virus
ggccaatagtagctattaccgtcg

SEQ ID NO: 440 - DNA, 24 bp, Vaccinia Virus
ttatcccaattaccaactagaagt

SEQ ID NO: 441 - DNA, 24 bp, Vaccinia Virus
ggaattggaggcgatgatcttaat

SEQ ID NO: 442 - DNA, 24 bp, Vaccinia Virus
gcgctcccctagtcgtactcagag

SEQ ID NO: 443 - DNA, 24 bp, Vaccinia Virus
ttagctgttttcatcaagatttgt

SEQ ID NO: 444 - DNA, 24 bp, Vaccinia Virus
tattatttataactgatgtaaccc

SEQ ID NO: 445 - DNA, 24 bp, Vaccinia Virus
acgcgtgtctaactagtggaggtt

SEQ ID NO: 446 - DNA, 24 bp, Vaccinia Virus
cgaggaggaatatcgtcggagctg

SEQ ID NO: 447 - DNA, 17 bp, Vaccinia Virus
tataccagaattaatgg

SEQ ID NO: 448 - DNA, 24 bp, Vaccinia Virus
tgaattgattcttgaggtataaac

SEQ ID NO: 449 - DNA, 24 bp, Vaccinia Virus
acgggaacagggtttgttgattcg

SEQ ID NO: 450 - DNA, 24 bp, Vaccinia Virus
tgcacgtaatctattatagatgcc

SEQ ID NO: 451 - DNA, 24 bp, Vaccinia Virus
ttcatatttattagataccgcatt

SEQ ID NO: 452 - DNA, 18 bp, Vaccinia Virus
tatgatcctctctcattg

SEQ ID NO: 453 - DNA, 24 bp, Vaccinia Virus
taggagagttactaggcccaactg

SEQ ID NO: 454 - DNA, 22 bp, Vaccinia Virus
taagtcttccaagttggcatca

SEQ ID NO: 455 - DNA, 24 bp, Vaccinia Virus
tagaatatactcaatagaatttgt

SEQ ID NO: 456 - DNA, 24 bp, Vaccinia Virus
taagatatgggattttacttaata

SEQ ID NO: 457 - DNA, 24 bp, Vaccinia Virus
tcaataacagttagtagtttagtt

SEQ ID NO: 458 - DNA, 24 bp, Vaccinia Virus
taaagctatcgtcattgatcatcg

SEQ ID NO: 459 - DNA, 24 bp, Vaccinia Virus
tcttattgtctgatttatttcttt

SEQ ID NO: 460 - DNA, 24 bp, Vaccinia Virus
tgttacgaaaatcaatatattcag

SEQ ID NO: 461 - DNA, 22 bp, Vaccinia Virus
ttagtcaatgctttaacgtaca

SEQ ID NO: 462 - DNA, 24 bp, Vaccinia Virus
tccaaattgcagtttctggtatcc

SEQ ID NO: 463 - DNA, 24 bp, Vaccinia Virus
taataagatgctaatacatcaggt

SEQ ID NO: 464 - DNA, 24 bp, Vaccinia Virus
tgagttggctactatcttgtacgt

SEQ ID NO: 465 - DNA, 20 bp, Vaccinia Virus
cggcatggtttctgtgacta

SEQ ID NO: 466 - DNA, 24 bp, Vaccinia Virus
tgatggacagatgatacaaataag

SEQ ID NO: 467 - DNA, 24 bp, Vaccinia Virus
cggtattttttatggcaaacttta

SEQ ID NO: 468 - DNA, 24 bp, Vaccinia Virus
tatcataagcttgactacatttgg

SEQ ID NO: 469 - DNA, 24 bp, Vaccinia Virus
tcaatgatttcatcaaccgttaga

SEQ ID NO: 470 - DNA, 24 bp, Vaccinia Virus
catggctccgtttaatttgttgat

SEQ ID NO: 471 - DNA, 21 bp, Vaccinia Virus
taactcggatctgctatatgg

SEQ ID NO: 472 - DNA, 24 bp, Vaccinia Virus
tgactagataaactatcagtaagt

SEQ ID NO: 473 - DNA, 24 bp, Vaccinia Virus
actatctttaatagaactcttttc

SEQ ID NO: 474 - DNA, 24 bp, Vaccinia Virus
tatggtattaagaattcgtttttc

SEQ ID NO: 475 - DNA, 24 bp, Vaccinia Virus
ttcctcggccattttaatatttaa

SEQ ID NO: 476 - DNA, 22 bp, Vaccinia Virus
tttgataaagccttcctcgcaa

SEQ ID NO: 477 - DNA, 24 bp, Vaccinia Virus
cgcctttatttccacattagatgg

SEQ ID NO: 478 - DNA, 21 bp, Vaccinia Virus
acatatccgttacaatttgtt

SEQ ID NO: 479 - DNA, 24 bp, Vaccinia Virus
tcaccacgtgtgtttcaggatcat

SEQ ID NO: 480 - DNA, 24 bp, Vaccinia Virus
tgctatttcggctgccagagtgtc

SEQ ID NO: 481 - DNA, 24 bp, Vaccinia Virus
taagatatgtttattcataaacgc

SEQ ID NO: 482 - DNA, 24 bp, Vaccinia Virus
tctatgttcctcgtttcctgtatt

SEQ ID NO: 483 - DNA, 24 bp, Vaccinia Virus
tatagtatctgaaatcatattcat

SEQ ID NO: 484 - DNA, 24 bp, Vaccinia Virus
tcgttgatctctcatagatttaga

SEQ ID NO: 485 - DNA, 24 bp, Vaccinia Virus
atgcatcggtaaatatagctgtat

SEQ ID NO: 486 - DNA, 24 bp, Vaccinia Virus
ttccttcggcatttctttttaatg

SEQ ID NO: 487 - DNA, 24 bp, Vaccinia Virus
taagataaactaaatctcgcaaag

SEQ ID NO: 488 - DNA, 24 bp, Vaccinia Virus
tgaaatccaaggatttattaatgt

SEQ ID NO: 489 - DNA, 24 bp, Vaccinia Virus
tagcaggacattgatgctctagac

SEQ ID NO: 490 - DNA, 24 bp, Vaccinia Virus
tccactatatgtttctgtagcggc

SEQ ID NO: 491 - DNA, 24 bp, Vaccinia Virus
ttccgcatattttaatgactcttc

SEQ ID NO: 492 - DNA, 24 bp, Vaccinia Virus
gagctcaacacttactccgccacc

SEQ ID NO: 493 - DNA, 24 bp, Vaccinia Virus
tgtggtagatttgttctatagagc

SEQ ID NO: 494 - DNA, 24 bp, Vaccinia Virus
aacagtatcatttaaacatttaac

SEQ ID NO: 495 - DNA, 24 bp, Vaccinia Virus
taatattgataaaatctccattct

SEQ ID NO: 496 - DNA, 24 bp, Vaccinia Virus
tgagaatatccatcgtttgcttgg

SEQ ID NO: 497 - DNA, 21 bp, Vaccinia Virus
tattaaagtcttctatttcta

SEQ ID NO: 498 - DNA, 24 bp, Vaccinia Virus
attattcttatcatgcgtccatag

SEQ ID NO: 499 - DNA, 24 bp, Vaccinia Virus
tttttagataaaaaatataatatt

SEQ ID NO: 500 - DNA, 24 bp, Vaccinia Virus
taccgtgtgggatataaaagtcct

SEQ ID NO: 501 - DNA, 24 bp, Vaccinia Virus
gtttactatttattgataacgcag

SEQ ID NO: 502 - DNA, 24 bp, Vaccinia Virus
catgtgaaaatagtcatattcctg

SEQ ID NO: 503 - DNA, 20 bp, Vaccinia Virus
tgaatacaacgaatacttca

SEQ ID NO: 504 - DNA, 24 bp, Vaccinia Virus
ttaattggtttaatcgtttattaa

SEQ ID NO: 505 - DNA, 23 bp, Vaccinia Virus
ttccacagagcactaatttccaa

SEQ ID NO: 506 - DNA, 24 bp, Vaccinia Virus
ccgcagcacaatgaaccaacacgg

SEQ ID NO: 507 - DNA, 24 bp, Vaccinia Virus
caatgtatatttatccatcgtcaa

SEQ ID NO: 508 - DNA, 24 bp, Vaccinia Virus
tgaagagccgcgtttaacaatgct

SEQ ID NO: 509 - DNA, 24 bp, Vaccinia Virus
ttgaatttactaatcttgcccttg

SEQ ID NO: 510 - DNA, 24 bp, Vaccinia Virus
tccaatcgcatagctataaaatag

SEQ ID NO: 511 - DNA, 24 bp, Vaccinia Virus
ttgatgttttggctgcttgtacgc

SEQ ID NO: 512 - DNA, 24 bp, Vaccinia Virus
agttatattttcgtctatccattg

SEQ ID NO: 513 - DNA, 24 bp, Vaccinia Virus
tctctgaatggatactagttttct

SEQ ID NO: 514 - DNA, 24 bp, Vaccinia Virus
tgtgatggaaaaatgactaatttt

SEQ ID NO: 515 - DNA, 24 bp, Vaccinia Virus
gataactgtatttttaatcacgtc

SEQ ID NO: 516 - DNA, 24 bp, Vaccinia Virus
ttcatgtgaaactttgtcctttcc

SEQ ID NO: 517 - DNA, 24 bp, Vaccinia Virus
tactcgatgcgtgagtcttgcatt

SEQ ID NO: 518 - DNA, 24 bp, Vaccinia Virus
tcgatactgcagagattctagtaa

SEQ ID NO: 519 - DNA, 24 bp, Vaccinia Virus
tggagaatttttttcagttgtttg

SEQ ID NO: 520 - DNA, 24 bp, Vaccinia Virus
ttagttcatcatatggaacttttt

SEQ ID NO: 521 - DNA, 24 bp, Vaccinia Virus
taagttattcatgacggtagcata

SEQ ID NO: 522 - DNA, 22 bp, Vaccinia Virus
cactagtttagattcaacatac

SEQ ID NO: 523 - DNA, 24 bp, Vaccinia Virus
tctatagcatctactaactgtaca

SEQ ID NO: 524 - DNA, 24 bp, Vaccinia Virus
tgtaagctctttttgaaattgatg

SEQ ID NO: 525 - DNA, 24 bp, Vaccinia Virus
atatcattgaccatttgtctggct

SEQ ID NO: 526 - DNA, 24 bp, Vaccinia Virus
tgggaataaaatactactgttgag

SEQ ID NO: 527 - DNA, 24 bp, Vaccinia Virus
tagcttctacagtctttcgtttcc

SEQ ID NO: 528 - DNA, 24 bp, Vaccinia Virus
tgagaaaagtgtgttctgaatcgc

SEQ ID NO: 529 - DNA, 24 bp, Vaccinia Virus
taggatatagtttcataataggaa

SEQ ID NO: 530 - DNA, 24 bp, Vaccinia Virus
tattacacacggaacgtttataac

SEQ ID NO: 531 - DNA, 24 bp, Vaccinia Virus
taacacgcttctgttctcatctat

SEQ ID NO: 532 - DNA, 24 bp, Vaccinia Virus
aggcatttcgtaatatgatattct

SEQ ID NO: 533 - DNA, 24 bp, Vaccinia Virus
tatagaaataatgataagtccatc

SEQ ID NO: 534 - DNA, 22 bp, Vaccinia Virus
tactaggtagcaaattgtctag

SEQ ID NO: 535 - DNA, 24 bp, Vaccinia Virus
ttcaatttatacggatttctatag

SEQ ID NO: 536 - DNA, 24 bp, Vaccinia Virus
actcgtttatgacaccataggcat

SEQ ID NO: 537 - DNA, 24 bp, Vaccinia Virus
tttctagttctaattatttcagaa

SEQ ID NO: 538 - DNA, 23 bp, Vaccinia Virus
catcgtatactcgaccatctacg

SEQ ID NO: 539 - DNA, 24 bp, Vaccinia Virus
tataaagtgcacgtttacatatct

SEQ ID NO: 540 - DNA, 21 bp, Vaccinia Virus
tgagaagtctttttcattagc

SEQ ID NO: 541 - DNA, 24 bp, Vaccinia Virus
ccgcactagcatcccctttcaata

SEQ ID NO: 542 - DNA, 21 bp, Vaccinia Virus
tgatatacctgtttttatttc

SEQ ID NO: 543 - DNA, 24 bp, Vaccinia Virus
taacgtatcgcattaatactgttt

SEQ ID NO: 544 - DNA, 24 bp, Vaccinia Virus
actagacatttaccatgggatgct

SEQ ID NO: 545 - DNA, 24 bp, Vaccinia Virus
tagattgttttcagtgagatgatt

SEQ ID NO: 546 - DNA, 24 bp, Vaccinia Virus
acgcatattctactcttggaatta

SEQ ID NO: 547 - DNA, 18 bp, Vaccinia Virus
ttcgtgttccaaacatta

SEQ ID NO: 548 - DNA, 24 bp, Vaccinia Virus
tataatctttttcatcttgtgagt

SEQ ID NO: 549 - DNA, 24 bp, Vaccinia Virus
cgttgtgtctacaaccgctacata

SEQ ID NO: 550 - DNA, 24 bp, Vaccinia Virus
taggtgctgaaataaccacatctg

SEQ ID NO: 551 - DNA, 17 bp, Vaccinia Virus
tacgtaaccgaatcttc

SEQ ID NO: 552 - DNA, 24 bp, Vaccinia Virus
tagaaggagtgttttcttggcaaa

SEQ ID NO: 553 - DNA, 24 bp, Vaccinia Virus
ggataatttaactactatattggc

SEQ ID NO: 554 - DNA, 24 bp, Vaccinia Virus
tatttagtttattcataatgttaa

SEQ ID NO: 555 - DNA, 24 bp, Vaccinia Virus
tgaaatagctcgtttctatttgtt

SEQ ID NO: 556 - DNA, 24 bp, Vaccinia Virus
agataatatcctgaacagcattgc

SEQ ID NO: 557 - DNA, 24 bp, Vaccinia Virus
tagtatagcgtcgtttaagagcag

SEQ ID NO: 558 - DNA, 24 bp, Vaccinia Virus
ttgaagtttccaaattttgataat

SEQ ID NO: 559 - DNA, 23 bp, Vaccinia Virus
ttctttgtattttggcatatcct

SEQ ID NO: 560 - DNA, 24 bp, Vaccinia Virus
tagtatttttctaacgtcggtatt

SEQ ID NO: 561 - DNA, 24 bp, Vaccinia Virus
aattttagaaataacattagcgaa

SEQ ID NO: 562 - DNA, 24 bp, Vaccinia Virus
tggctacaaacttttccttttcca

SEQ ID NO: 563 - DNA, 24 bp, Vaccinia Virus
tttccggctgttgtatatttaaat

SEQ ID NO: 564 - DNA, 24 bp, Vaccinia Virus
tagcatcgctttgagattctccat

SEQ ID NO: 565 - DNA, 24 bp, Vaccinia Virus
ttcctctggagatgacactacggc

SEQ ID NO: 566 - DNA, 24 bp, Vaccinia Virus
tattgtttaatcgttttatagatt

SEQ ID NO: 567 - DNA, 23 bp, Vaccinia Virus
ggaggtggagtatcgtcaataat

SEQ ID NO: 568 - DNA, 24 bp, Vaccinia Virus
tatcagatgattttgtattagatc

SEQ ID NO: 569 - DNA, 24 bp, Vaccinia Virus
actacctttgtcacccaactttat

SEQ ID NO: 570 - DNA, 24 bp, Vaccinia Virus
tgaagtaattaatttttctgcctc

SEQ ID NO: 571 - DNA, 24 bp, Vaccinia Virus
attcacgtgacgtggtatcaatta

SEQ ID NO: 572 - DNA, 24 bp, Vaccinia Virus
tacaattagacgtaagttctgctt

SEQ ID NO: 573 - DNA, 24 bp, Vaccinia Virus
tacatgtaatacattttgaactct

SEQ ID NO: 574 - DNA, 24 bp, Vaccinia Virus
tcgaaaacaaaaatagatattatt

SEQ ID NO: 575 - DNA, 24 bp, Vaccinia Virus
tgtatagaggacgttttgattcga

SEQ ID NO: 576 - DNA, 24 bp, Vaccinia Virus
tttatctacagacagactaataat

SEQ ID NO: 577 - DNA, 24 bp, Vaccinia Virus
tttgtacagactaagtaattcttt

SEQ ID NO: 578 - DNA, 22 bp, Vaccinia Virus
aacatctttgaaatctttactt

SEQ ID NO: 579 - DNA, 23 bp, Vaccinia Virus
tatccagagatatcttgtaatgg

SEQ ID NO: 580 - DNA, 24 bp, Vaccinia Virus
tacttctttaaagtactcgttttg

SEQ ID NO: 581 - DNA, 24 bp, Vaccinia Virus
tctaaattcggcaggaaagtcaca

SEQ ID NO: 582 - DNA, 23 bp, Vaccinia Virus
ataaatttataatgttcgccatt

SEQ ID NO: 583 - DNA, 24 bp, Vaccinia Virus
tccctaataacttcgtgaataatg

SEQ ID NO: 584 - DNA, 24 bp, Vaccinia Virus
gtttcagcgtgattttccaaccta

SEQ ID NO: 585 - DNA, 24 bp, Vaccinia Virus
tagcctctggctttttatcagcct

SEQ ID NO: 586 - DNA, 24 bp, Vaccinia Virus
tgagatcaactttatctaatggtt

SEQ ID NO: 587 - DNA, 24 bp, Vaccinia Virus
tggaatagttttttactagtaaag

SEQ ID NO: 588 - DNA, 24 bp, Vaccinia Virus
gatgccatgttaaaaatgtccgcc

SEQ ID NO: 589 - DNA, 24 bp, Vaccinia Virus
agcatcatctttagatcattaatt

SEQ ID NO: 590 - DNA, 24 bp, Vaccinia Virus
taaaatacaaatgacattccctta

SEQ ID NO: 591 - DNA, 24 bp, Vaccinia Virus
acactgataaaccgcattatctgt

SEQ ID NO: 592 - DNA, 24 bp, Vaccinia Virus
tttattgggtagtgttgatgattc

SEQ ID NO: 593 - DNA, 24 bp, Vaccinia Virus
taactagtgtagaaaacagagata

SEQ ID NO: 594 - DNA, 24 bp, Vaccinia Virus
atattatctacgtcattgttttgt

SEQ ID NO: 595 - DNA, 24 bp, Vaccinia Virus
tattatactcatgcctagtaatag

SEQ ID NO: 596 - DNA, 23 bp, Vaccinia Virus
aacgatgttaccaatcgtttgct

SEQ ID NO: 597 - DNA, 24 bp, Vaccinia Virus
agtgaaaagaatgtaaactttgtc

SEQ ID NO: 598 - DNA, 24 bp, Vaccinia Virus
ttaggtttgttcattgtcgtgtgg

SEQ ID NO: 599 - DNA, 24 bp, Vaccinia Virus
tatagtgtaacacgaatgcagttt

SEQ ID NO: 600 - DNA, 24 bp, Vaccinia Virus
tttatctattgatggtgtatgaac

SEQ ID NO: 601 - DNA, 24 bp, Vaccinia Virus
taaaatgctaatgtcaagtttatt

SEQ ID NO: 602 - DNA, 24 bp, Vaccinia Virus
ttccgtagtccatggatccaaact

SEQ ID NO: 603 - DNA, 24 bp, Vaccinia Virus
aagagttttagttgtctagtattt

SEQ ID NO: 604 - DNA, 24 bp, Vaccinia Virus
tgaatggatttatcatcatcgttt

SEQ ID NO: 605 - DNA, 24 bp, Vaccinia Virus
gatgaccatatatttattttcagt

SEQ ID NO: 606 - DNA, 24 bp, Vaccinia Virus
taaggtgattggaatgggataaat

SEQ ID NO: 607 - DNA, 24 bp, Vaccinia Virus
acgtcatttaataaaaaaagtatt

SEQ ID NO: 608 - DNA, 24 bp, Vaccinia Virus
tggcaataactaattgagatattg

SEQ ID NO: 609 - DNA, 24 bp, Vaccinia Virus
gatatgataacaggaataacatct

SEQ ID NO: 610 - DNA, 24 bp, Vaccinia Virus
cgtccatattttattctgaggcct

SEQ ID NO: 611 - DNA, 24 bp, Vaccinia Virus
tatggcaaatctgcaatcactgta

SEQ ID NO: 612 - DNA, 24 bp, Vaccinia Virus
caccgtaaatttatcaccagaaat

SEQ ID NO: 613 - DNA, 24 bp, Vaccinia Virus
taaggtactttttctcataataaa

SEQ ID NO: 614 - DNA, 24 bp, Vaccinia Virus
tttgttctatcaactacctataaa

SEQ ID NO: 615 - DNA, 24 bp, Vaccinia Virus
atccaatttgtaaaaaatcagcgg

SEQ ID NO: 616 - DNA, 24 bp, Vaccinia Virus
tcatttcccatgtattttttttat

SEQ ID NO: 617 - DNA, 24 bp, Vaccinia Virus
tggaattgggctccttataccaag

SEQ ID NO: 618 - DNA, 24 bp, Vaccinia Virus
tatcaaatgatcctgttgggcatt

SEQ ID NO: 619 - DNA, 24 bp, Vaccinia Virus
ttaataattacttatcttttgacg

SEQ ID NO: 620 - DNA, 24 bp, Vaccinia Virus
tattattattggctctgatcaccg

SEQ ID NO: 621 - DNA, 24 bp, Vaccinia Virus
tgtaaaatttttgtcgataaaaat

SEQ ID NO: 622 - DNA, 24 bp, Vaccinia Virus
tcgtacccaccgagagcgtgtgcg

SEQ ID NO: 623 - DNA, 18 bp, Vaccinia Virus
ttcgttgtatatagtacg

SEQ ID NO: 624 - DNA, 24 bp, Vaccinia Virus
taacggagattaaaaatatgacgc

SEQ ID NO: 625 - DNA, 24 bp, Vaccinia Virus
gttgttgtttgcgactgcttccga

SEQ ID NO: 626 - DNA, 24 bp, Vaccinia Virus
tgtgacacccattcatctggagaa

SEQ ID NO: 627 - DNA, 24 bp, Vaccinia Virus
tcttttaccaacacaaagggtgga

SEQ ID NO: 628 - DNA, 24 bp, Vaccinia Virus
tgaggctacctcgacatacgtgtg

SEQ ID NO: 629 - DNA, 24 bp, Vaccinia Virus
taacatgttacagaatataaatta

SEQ ID NO: 630 - DNA, 24 bp, Vaccinia Virus
tgagatattctgagcgctaacctt

SEQ ID NO: 631 - DNA, 24 bp, Vaccinia Virus
tgtacaaattgatatggtcgtcgt

SEQ ID NO: 632 - DNA, 24 bp, Vaccinia Virus
catggagtagatgatagaggggaa

SEQ ID NO: 633 - DNA, 24 bp, Vaccinia Virus
aagttggctgtcatcttaccaatt

SEQ ID NO: 634 - DNA, 24 bp, Vaccinia Virus
aattatagatacgctattaattat

SEQ ID NO: 635 - DNA, 22 bp, Vaccinia Virus
ttagatatccgtaacactacca

SEQ ID NO: 636 - DNA, 24 bp, Vaccinia Virus
tggtaagattactggctcgttttc

SEQ ID NO: 637 - DNA, 24 bp, Vaccinia Virus
aagaatttatataaatcattccat

SEQ ID NO: 638 - DNA, 24 bp, Vaccinia Virus
tgtatgctcctagcggagttaatc

SEQ ID NO: 639 - DNA, 24 bp, Vaccinia Virus
tcagtaataataattcagtaatgt

SEQ ID NO: 640 - DNA, 24 bp, Vaccinia Virus
tctacatttatatgttctctatcg

SEQ ID NO: 641 - DNA, 24 bp, Vaccinia Virus
tacaaatagcagtgtagtgcagta

SEQ ID NO: 642 - DNA, 24 bp, Vaccinia Virus
attgtcccacggaagtgaatcctt

SEQ ID NO: 643 - DNA, 24 bp, Vaccinia Virus
tgagaaagaccagtagtattggat

SEQ ID NO: 644 - DNA, 19 bp, Vaccinia Virus
tagtttatcatataccttt

SEQ ID NO: 645 - DNA, 24 bp, Vaccinia Virus
ttctggtctcggattaggcgtcgt

SEQ ID NO: 646 - DNA, 24 bp, Vaccinia Virus
ccttttttatcgttatcggttttc

SEQ ID NO: 647 - DNA, 24 bp, Vaccinia Virus
tagaatatattttaaaggacttat

SEQ ID NO: 648 - DNA, 22 bp, Vaccinia Virus
tctatgggtccatctatgagaa

SEQ ID NO: 649 - DNA, 24 bp, Vaccinia Virus
ataagtggacatatagatgcagaa

SEQ ID NO: 650 - DNA, 24 bp, Vaccinia Virus
tgtctaaatgtaattatgatcttg

SEQ ID NO: 651 - DNA, 24 bp, Vaccinia Virus
atggttctttccgtacaacatact

SEQ ID NO: 652 - DNA, 24 bp, Vaccinia Virus
tgactcgtcccttaataggcagta

SEQ ID NO: 653 - DNA, 24 bp, Vaccinia Virus
gattgtatcagtttcgtagtcttg

SEQ ID NO: 654 - DNA, 24 bp, Vaccinia Virus
taacatcgattcccatatgatgtt

SEQ ID NO: 655 - DNA, 24 bp, Vaccinia Virus
tgatggagtcgtaaaaaagtttta

SEQ ID NO: 656 - DNA, 24 bp, Vaccinia Virus
tgatggagtcgtaaaaaagtttta

SEQ ID NO: 657 - DNA, 24 bp, Vaccinia Virus
tgatggagtcgtaaaaaagtttta

SEQ ID NO: 658 - DNA, 24 bp, Vaccinia Virus
tgatggagtcgtaaaaaagtttta

SEQ ID NO: 659 - DNA, 24 bp, Vaccinia Virus
tgatggagtcgtaaaaaagtttta

SEQ ID NO: 660 - DNA, 24 bp, Vaccinia Virus
tgatggagtcgtaaaaaagtttta

SEQ ID NO: 661 - DNA, 24 bp, Vaccinia Virus
tgatggagtcgtaaaaaagtttta

SEQ ID NO: 662 - DNA, 24 bp, Vaccinia Virus
tgatggagtcgtaaaaaagtttta

SEQ ID NO: 663 - DNA, 24 bp, Vaccinia Virus
tgatggagtcgtaaaaaagtttta

SEQ ID NO: 664 - DNA, 24 bp, Vaccinia Virus
tgatggagtcgtaaaaaagtttta

SEQ ID NO: 665 - DNA, 24 bp, Vaccinia Virus
tgatggagtcgtaaaaaagtttta

SEQ ID NO: 666 - DNA, 24 bp, Vaccinia Virus
cgtaaaaaagttttatctttctct

SEQ ID NO: 667 - DNA, 24 bp, Vaccinia Virus
taagttagtaatacataaatttta

SEQ ID NO: 668 - DNA, 24 bp, Vaccinia Virus
tgatggagtcgtaaaaaagtttta

SEQ ID NO: 669 - DNA, 24 bp, Vaccinia Virus
tgatggagtcgtaaaaaagtttta

SEQ ID NO: 670 - DNA, 24 bp, Vaccinia Virus
tgatggagtcgtaaaaaagtttta

SEQ ID NO: 671 - DNA, 24 bp, Vaccinia Virus
tgatggagtcgtaaaaaagtttta

SEQ ID NO: 672 - DNA, 24 bp, Vaccinia Virus
ataaaaaaagttttacaaaaatat

SEQ ID NO: 673 - DNA, 24 bp, Vaccinia Virus
taaaatatttttattctctttctc

SEQ ID NO: 674 - DNA, 24 bp, Vaccinia Virus
tgatggagtcgtaaaaaagtttta

SEQ ID NO: 675 - DNA, 24 bp, Vaccinia Virus
tctttggtacaaaatttcacacaa

SEQ ID NO: 676 - DNA, 24 bp, Vaccinia Virus
tgagaccatcgaaggagactccat

SEQ ID NO: 677 - DNA, 24 bp, Vaccinia Virus
aatatttttgtaaaacttttttta

SEQ ID NO: 678 - DNA, 24 bp, Vaccinia Virus
aatatttttgtaaaacttttttta

SEQ ID NO: 679 - DNA, 24 bp, Vaccinia Virus
ttatacgatctacgttttattata

SEQ ID NO: 680 - DNA, 24 bp, Vaccinia Virus
catcagaaagaggtttaatatttt

SEQ ID NO: 681 - DNA, 24 bp, Vaccinia Virus
catcagaaagaggtttaatatttt

SEQ ID NO: 682 - DNA, 24 bp, Vaccinia Virus
catcagaaagaggtttaatatttt

SEQ ID NO: 683 - DNA, 24 bp, Vaccinia Virus
catcagaaagaggtttaatatttt

SEQ ID NO: 684 - DNA, 24 bp, Vaccinia Virus
catcagaaagaggtttaatatttt

SEQ ID NO: 685 - DNA, 24 bp, Vaccinia Virus
catcagaaagaggtttaatatttt

SEQ ID NO: 686 - DNA, 24 bp, Vaccinia Virus
catcagaaagaggtttaatatttt

SEQ ID NO: 687 - DNA, 24 bp, Vaccinia Virus
catcagaaagaggtttaatatttt

SEQ ID NO: 688 - DNA, 24 bp, Vaccinia Virus
tgaatagagttatcgattcagaca

SEQ ID NO: 689 - DNA, 24 bp, Vaccinia Virus
agaggtttaatatttttgtgagac

SEQ ID NO: 690 - DNA, 24 bp, Vaccinia Virus
agagagaaagagaataaaaatatt

SEQ ID NO: 691 - DNA, 24 bp, Vaccinia Virus
gaagagagaaagagaataaaaata

SEQ ID NO: 692 - DNA, 24 bp, Vaccinia Virus
tcaatgttttaaaatatatggaca

SEQ ID NO: 693 - DNA, 24 bp, Vaccinia Virus
ttggttgtggatcttctacaatat

SEQ ID NO: 694 - DNA, 24 bp, Vaccinia Virus
tatcataaagggtatgctcatggc

SEQ ID NO: 695 - DNA, 24 bp, Vaccinia Virus
tgatacatgtattaaaatactttc

SEQ ID NO: 696 - DNA, 24 bp, Vaccinia Virus
tcgattccgtccaagatgataaaa

SEQ ID NO: 697 - DNA, 24 bp, Vaccinia Virus
taatgtcctgtttcatttgtttcc

SEQ ID NO: 698 - DNA, 24 bp, Vaccinia Virus
tgattggagaagtaggaaacagga

SEQ ID NO: 699 - DNA, 21 bp, Vaccinia Virus
cagccccagctgctcctcctc

SEQ ID NO: 700 - DNA, 19 bp, Vaccinia Virus
taacttggcaaaagactta

SEQ ID NO: 701 - DNA, 18 bp, Vaccinia Virus
ttattattgatgataaga

SEQ ID NO: 702 - DNA, 24 bp, Vaccinia Virus
acttctgtatagtttatttagtca

SEQ ID NO: 703 - DNA, 17 bp, Vaccinia Virus
tattttattctttcttc

SEQ ID NO: 704 - DNA, 18 bp, Vaccinia Virus
cggaaacagacaagcaac

SEQ ID NO: 705 - DNA, 23 bp, Vaccinia Virus
aaaaagcagaggccaagagtttg

SEQ ID NO: 706 - DNA, 21 bp, Vaccinia Virus
atacgcaaacacaccgatgca

SEQ ID NO: 707 - DNA, 18 bp, Vaccinia Virus
aaaggcaaatcatttgga

SEQ ID NO: 708 - DNA, 18 bp, Vaccinia Virus
aatggagagaatacaata

SEQ ID NO: 709 - DNA, 18 bp, Vaccinia Virus
gcgtgtgtgtagacacac

SEQ ID NO: 710 - DNA, 23 bp, Vaccinia Virus
agaaaataagtatccatcagaga

SEQ ID NO: 711 - DNA, 19 bp, Vaccinia Virus
catttcacaaatgtttagt

SEQ ID NO: 712 - DNA, 21 bp, Vaccinia Virus
accctgtcattacgtcaacgc

SEQ ID NO: 713 - DNA, 16 bp, Vaccinia Virus
cccctccatctgttcc

SEQ ID NO: 714 - DNA, 21 bp, Vaccinia Virus
tctgctgctctgccactcagc

SEQ ID NO: 715 - DNA, 18 bp, Vaccinia Virus
aagtagtggattcaaaga

SEQ ID NO: 716 - DNA, 21 bp, Vaccinia Virus
gacaaagtaattcctctcact

SEQ ID NO: 717 - DNA, 17 bp, Vaccinia Virus
ttctatcctacaacaag

SEQ ID NO: 718 - DNA, 18 bp, Vaccinia Virus
cctctcattccagaggaa

SEQ ID NO: 719 - DNA, 22 bp, Vaccinia Virus
gacaaagttttgctcttgtcac

SEQ ID NO: 720 - DNA, 22 bp, Vaccinia Virus
tgaagcatttactttgtgttca

SEQ ID NO: 721 - DNA, 20 bp, Vaccinia Virus
ttctattttacaactacaaa

SEQ ID NO: 722 - DNA, 21 bp, Vaccinia Virus
aatgtttatgataataaaggc

SEQ ID NO: 723 - DNA, 16 bp, Vaccinia Virus
tgaagtattgtgttta

SEQ ID NO: 724 - DNA, 22 bp, Vaccinia Virus
tctaaatcaccagagaccaaac

SEQ ID NO: 725 - DNA, 19 bp, Vaccinia Virus
aggccctaaaaagccagag

SEQ ID NO: 726 - DNA, 16 bp, Vaccinia Virus
agggggaagactttaa

SEQ ID NO: 727 - DNA, 24 bp, Vaccinia Virus
aagcaaaatactaatctaattgtg

SEQ ID NO: 728 - DNA, 19 bp, Vaccinia Virus
catataaatgtggaggcta

SEQ ID NO: 729 - DNA, 19 bp, Vaccinia Virus
caggtaccaggtagcccca

SEQ ID NO: 730 - DNA, 18 bp, Vaccinia Virus
tcccttctcatctcccca

SEQ ID NO: 731 - DNA, 21 bp, Vaccinia Virus
taagggaaccgtctgttttta

SEQ ID NO: 732 - DNA, 19 bp, Vaccinia Virus
atgatcctaaaaataaccg

SEQ ID NO: 733 - DNA, 16 bp, Vaccinia Virus
cctgctctctccagag

SEQ ID NO: 734 - DNA, 21 bp, Vaccinia Virus
ggtggcctaagagttgagctc

SEQ ID NO: 735 - DNA, 20 bp, Vaccinia Virus
aagtccttccaattatattt

SEQ ID NO: 736 - DNA, 24 bp, Vaccinia Virus
tcctactttgcttctctccaccca

SEQ ID NO: 737 - DNA, 18 bp, Vaccinia Virus
gagaagagaagcgtgtta

SEQ ID NO: 738 - DNA, 17 bp, Vaccinia Virus
gcaggtgcttcaggata

SEQ ID NO: 739 - DNA, 24 bp, Vaccinia Virus
tccaccctatatgtagtataaaga

SEQ ID NO: 740 - DNA, 22 bp, Vaccinia Virus
ttcccctccactcagaaacccc

SEQ ID NO: 741 - DNA, 22 bp, Vaccinia Virus
tgtgacttccaagtagaattta

SEQ ID NO: 742 - DNA, 18 bp, Vaccinia Virus
ttctgtgtcataccacaa

SEQ ID NO: 743 - DNA, 20 bp, Vaccinia Virus
gaaaatatgatgtttcacat

SEQ ID NO: 744 - DNA, 20 bp, Vaccinia Virus
gtcataggatttgaaagctg

SEQ ID NO: 745 - DNA, 17 bp, Vaccinia Virus
ccagtattaaattatcc

SEQ ID NO: 746 - DNA, 16 bp, Vaccinia Virus
ttctttccaccacaaa

SEQ ID NO: 747 - DNA, 23 bp, Vaccinia Virus
aaaactctcctacacttccatta

SEQ ID NO: 748 - DNA, 18 bp, Vaccinia Virus
ttttgtggctttctttct

SEQ ID NO: 749 - DNA, 24 bp, Vaccinia Virus
aaaaaatggtgtctatgaatttct

SEQ ID NO: 750 - DNA, 22 bp, Vaccinia Virus
aaaggaaaggcatcactatgga

SEQ ID NO: 751 - DNA, 20 bp, Vaccinia Virus
atcacgtcagtaaaatacta

SEQ ID NO: 752 - DNA, 22 bp, Vaccinia Virus
agctcctaggccagggcctgtc

SEQ ID NO: 753 - DNA, 19 bp, Vaccinia Virus
tattcctttttctctcctc

SEQ ID NO: 754 - DNA, 20 bp, Vaccinia Virus
tctagagcatggagcctcta

SEQ ID NO: 755 - DNA, 18 bp, Vaccinia Virus
agcccaccatttctcctc

SEQ ID NO: 756 - DNA, 18 bp, Vaccinia Virus
tattccttatttctcttt

SEQ ID NO: 757 - DNA, 22 bp, Vaccinia Virus
aggcaaaaaaattaaattattt

SEQ ID NO: 758 - DNA, 22 bp, Vaccinia Virus
aggctggtgacaggccaaaggc

SEQ ID NO: 759 - DNA, 18 bp, Vaccinia Virus
ccgcagcgcgcggaggaa

SEQ ID NO: 760 - DNA, 18 bp, Vaccinia Virus
aatgacatttgtatttta

SEQ ID NO: 761 - DNA, 16 bp, Vaccinia Virus
cctgatgcaaattgga

SEQ ID NO: 762 - DNA, 20 bp, Vaccinia Virus
tatactacagcagaatgact

SEQ ID NO: 763 - DNA, 18 bp, Vaccinia Virus
tgtggcatttgtaccaaa

SEQ ID NO: 764 - DNA, 22 bp, Vaccinia Virus
tctcaaatgaaaaagtcttcga

SEQ ID NO: 765 - DNA, 23 bp, Vaccinia Virus
cagccccggccggcgcctcctcg

SEQ ID NO: 766 - DNA, 21 bp, Vaccinia Virus
tccatatactttggggacttg

SEQ ID NO: 767 - DNA, 18 bp, Vaccinia Virus
gctgaaaactgcaacttg

SEQ ID NO: 768 - DNA, 18 bp, Vaccinia Virus
ggcaataaatgttgagcc

SEQ ID NO: 769 - DNA, 21 bp, Vaccinia Virus
aggcatgattaaaatatggac

SEQ ID NO: 770 - DNA, 23 bp, Vaccinia Virus
ataaagccaggtacacgaggcag

SEQ ID NO: 771 - DNA, 20 bp, Vaccinia Virus
gtgggtcatcccagcacctg

SEQ ID NO: 772 - DNA, 18 bp, Vaccinia Virus
ttacttagcatgcacaaa

SEQ ID NO: 773 - DNA, 19 bp, Vaccinia Virus
tggagaggaagaaacgcta

SEQ ID NO: 774 - DNA, 22 bp, Vaccinia Virus
attaactccgtttccaaataca

SEQ ID NO: 775 - DNA, 18 bp, Vaccinia Virus
gtgtgtttacctaaacta

SEQ ID NO: 776 - DNA, 20 bp, Vaccinia Virus
tgatgtaggacttggaaaac

SEQ ID NO: 777 - DNA, 22 bp, Vaccinia Virus
ggcttagtaatagatcacggca

SEQ ID NO: 778 - DNA, 18 bp, Vaccinia Virus
ctgcaccctgccacttgt

SEQ ID NO: 779 - DNA, 19 bp, Vaccinia Virus
cagtgccaaaaacaacaac

SEQ ID NO: 780 - DNA, 22 bp, Vaccinia Virus
agaaagagaaatgaaatatttt

SEQ ID NO: 781 - DNA, 22 bp, Vaccinia Virus
tatttttgctctccctcccttc

SEQ ID NO: 782 - DNA, 18 bp, Vaccinia Virus
agaacatcctccaattcc

SEQ ID NO: 783 - DNA, 23 bp, Vaccinia Virus
agagaaagtctgacttgccccac

SEQ ID NO: 784 - DNA, 19 bp, Vaccinia Virus
gaaattaatctctggggaa

SEQ ID NO: 785 - DNA, 19 bp, Vaccinia Virus
aaaaaaagttacagaaata

SEQ ID NO: 786 - DNA, 22 bp, Vaccinia Virus
cagaaatggacattttcatatg

SEQ ID NO: 787 - DNA, 21 bp, Vaccinia Virus
ttgaaaattccgtctgtggga

SEQ ID NO: 788 - DNA, 21 bp, Vaccinia Virus
ttcccctttccccactccctg

SEQ ID NO: 789 - DNA, 18 bp, Vaccinia Virus
gtaatagctctatcagcc

SEQ ID NO: 790 - DNA, 24 bp, Vaccinia Virus
ctatagagtattccataatttgaa

SEQ ID NO: 791 - DNA, 21 bp, Vaccinia Virus
cccctctaccaagccactcca

SEQ ID NO: 792 - DNA, 18 bp, Vaccinia Virus
ttcacaagccattaggga

SEQ ID NO: 793 - DNA, 20 bp, Vaccinia Virus
acctgaactattagcacgtc

SEQ ID NO: 794 - DNA, 21 bp, Vaccinia Virus
tggaaaagaatccctgcagcc

SEQ ID NO: 795 - DNA, 24 bp, Vaccinia Virus
tgtctgttgaccaatctctattca

SEQ ID NO: 796 - DNA, 18 bp, Vaccinia Virus
agcaataaaagcgtgtta

SEQ ID NO: 797 - DNA, 19 bp, Vaccinia Virus
atgccacccttttggaagc

SEQ ID NO: 798 - DNA, 18 bp, Vaccinia Virus
acactctgagaaagagca

SEQ ID NO: 799 - DNA, 17 bp, Vaccinia Virus
tgcaaatcctacccctg

SEQ ID NO: 800 - DNA, 19 bp, Vaccinia Virus
aagcaaagatttcagtaga

SEQ ID NO: 801 - DNA, 18 bp, Vaccinia Virus
gtggtcatttcagcccta

SEQ ID NO: 802 - DNA, 18 bp, Vaccinia Virus
agccacagaagctgtgcc

SEQ ID NO: 803 - DNA, 17 bp, Vaccinia Virus
gtcaggattgaaagctg

SEQ ID NO: 804 - DNA, 24 bp, Vaccinia Virus
actgaaacatgcttaccagattca

SEQ ID NO: 805 - DNA, 19 bp, Vaccinia Virus
ctaaatctgaggaatcaac

SEQ ID NO: 806 - DNA, 20 bp, Vaccinia Virus
ttagcatttgctaccaagta

SEQ ID NO: 807 - DNA, 19 bp, Vaccinia Virus
tgtattctgtaacagatta

SEQ ID NO: 808 - DNA, 20 bp, Vaccinia Virus
gaaacgaaagaaagcaaagc

SEQ ID NO: 809 - DNA, 19 bp, Vaccinia Virus
tatgctgacagaagaacca

SEQ ID NO: 810 - DNA, 23 bp, Vaccinia Virus
gaaacaaaatcctcaggaaatta

SEQ ID NO: 811 - DNA, 17 bp, Vaccinia Virus
ggactctctcacacagg

SEQ ID NO: 812 - DNA, 18 bp, Vaccinia Virus
ggatgaatggatgtccca

SEQ ID NO: 813 - DNA, 30 bp, Vaccinia Virus
atattttttctgatcccccactctctcttc

SEQ ID NO: 814 - DNA, 17 bp, Vaccinia Virus
agtgttacactgtttga

SEQ ID NO: 815 - DNA, 22 bp, Vaccinia Virus
taaaggtatgtgctatgataaa

SEQ ID NO: 816 - DNA, 18 bp, Vaccinia Virus
gagggtatttgtagttta

SEQ ID NO: 817 - DNA, 21 bp, Vaccinia Virus
taatttatattctttccatgt

SEQ ID NO: 818 - DNA, 21 bp, Vaccinia Virus
gagaaagggcaaattatttta

SEQ ID NO: 819 - DNA, 21 bp, Vaccinia Virus
tattgaaaaaagatgacctgc

SEQ ID NO: 820 - DNA, 21 bp, Vaccinia Virus
tattgagatgacactaggtgc

SEQ ID NO: 821 - DNA, 23 bp, Vaccinia Virus
ggtagcgtgcacggtgttgaact

SEQ ID NO: 822 - DNA, 23 bp, Vaccinia Virus
aatattttcgtgtctgtctctct

SEQ ID NO: 823 - DNA, 17 bp, Vaccinia Virus
gaaattggctggtggaa

SEQ ID NO: 824 - DNA, 17 bp, Vaccinia Virus
agaactgaagactttaa

SEQ ID NO: 825 - DNA, 16 bp, Vaccinia Virus
tccccagtggtgggtg

SEQ ID NO: 826 - DNA, 18 bp, Vaccinia Virus
ggaaaggacaaagccaca

SEQ ID NO: 827 - DNA, 19 bp, Vaccinia Virus
aagcagaggcagtctattg

SEQ ID NO: 828 - DNA, 20 bp, Vaccinia Virus
tttatcataaacattttaca

SEQ ID NO: 829 - DNA, 19 bp, Vaccinia Virus
ttctcatacctgcccacag

SEQ ID NO: 830 - DNA, 22 bp, Vaccinia Virus
taatttatattctgctctaata

SEQ ID NO: 831 - DNA, 22 bp, Vaccinia Virus
tctcgggatgaaacggaatcga

SEQ ID NO: 832 - DNA, 18 bp, Vaccinia Virus
ttttcctctctttctctt

SEQ ID NO: 833 - DNA, 22 bp, Vaccinia Virus
aattgtacaatacttgcattcc

SEQ ID NO: 834 - DNA, 20 bp, Vaccinia Virus
aggactttcacaccataagg

SEQ ID NO: 835 - DNA, 17 bp, Vaccinia Virus
tctactaaaactacaaa

SEQ ID NO: 836 - DNA, 20 bp, Vaccinia Virus
tctaaatgttgaaagatcaa

SEQ ID NO: 837 - DNA, 16 bp, Vaccinia Virus
agggggaagactttaa

SEQ ID NO: 838 - DNA, 23 bp, Vaccinia Virus
ccatcatttggaaaaataaaggc

SEQ ID NO: 839 - DNA, 18 bp, Vaccinia Virus
tgtgaatgtcctgtggaa

SEQ ID NO: 840 - DNA, 18 bp, Vaccinia Virus
atttttgttactctcttc

SEQ ID NO: 841 - DNA, 24 bp, Vaccinia Virus
gttcatacttctccaataaataaa

SEQ ID NO: 842 - DNA, 19 bp, Vaccinia Virus
acttacttatttttatcta

SEQ ID NO: 843 - DNA, 19 bp, Vaccinia Virus
aggactttctcttctacac

SEQ ID NO: 844 - DNA, 18 bp, Vaccinia Virus
cccatttccttccagtca

SEQ ID NO: 845 - DNA, 18 bp, Vaccinia Virus
ttctcataaatggatctg

SEQ ID NO: 846 - DNA, 23 bp, Vaccinia Virus
ccctgcagtgcagacatcgtcaa

SEQ ID NO: 847 - DNA, 19 bp, Vaccinia Virus
gaggtttctcagaatatct

SEQ ID NO: 848 - DNA, 18 bp, Vaccinia Virus
tgtgtgaactagcaaaga

SEQ ID NO: 849 - DNA, 22 bp, Vaccinia Virus
ccacttttctaccagtaaaaga

SEQ ID NO: 850 - DNA, 21 bp, Vaccinia Virus
taattcttgttctgtaacatg

SEQ ID NO: 851 - DNA, 17 bp, Vaccinia Virus
tgtttctgtttcatatc

SEQ ID NO: 852 - DNA, 18 bp, Vaccinia Virus
taagaagaaatgcaaaag

SEQ ID NO: 853 - DNA, 23 bp, Vaccinia Virus
aaagaagagtttacagacaataa

SEQ ID NO: 854 - DNA, 24 bp, Vaccinia Virus
gaggggaaaaaattaactgctcca

SEQ ID NO: 855 - DNA, 21 bp, Vaccinia Virus
aaaactttatgaacttcacca

SEQ ID NO: 856 - DNA, 20 bp, Vaccinia Virus
gaagacagacatctgtggaa

SEQ ID NO: 857 - DNA, 21 bp, Vaccinia Virus
cagcccagcaccccttcctcg

SEQ ID NO: 858 - DNA, 22 bp, Vaccinia Virus
cagtgatgactattctcaaatg

SEQ ID NO: 859 - DNA, 18 bp, Vaccinia Virus
tttgattgggatgttata

SEQ ID NO: 860 - DNA, 17 bp, Vaccinia Virus
ctctgagtcctgaggag

SEQ ID NO: 861 - DNA, 22 bp, Vaccinia Virus
aaataacagaaaacccagcaaa

SEQ ID NO: 862 - DNA, 20 bp, Vaccinia Virus
aaataatctgaaactagaaa

SEQ ID NO: 863 - DNA, 25 bp, Vaccinia Virus
atccacatggtacaagcctttctca

SEQ ID NO: 864 - DNA, 19 bp, Vaccinia Virus
tagaaatagatatttttaa

SEQ ID NO: 865 - DNA, 22 bp, Vaccinia Virus
aaaactcaaacgaataaaaaag

SEQ ID NO: 866 - DNA, 20 bp, Vaccinia Virus
aagagtcatcatagtaggaa

SEQ ID NO: 867 - DNA, 18 bp, Vaccinia Virus
tgttcttttcctctcttc

SEQ ID NO: 868 - DNA, 18 bp, Vaccinia Virus
acctaactgcaatgtgga

SEQ ID NO: 869 - DNA, 21 bp, Vaccinia Virus
aggaacaaaaattacaaagaa

SEQ ID NO: 870 - DNA, 22 bp, Vaccinia Virus
ttgccactcccccactccttct

SEQ ID NO: 871 - DNA, 24 bp, Vaccinia Virus
taaaatctatgtgttttagactta

SEQ ID NO: 872 - DNA, 23 bp, Vaccinia Virus
tactgcactaccaaattcatttg

SEQ ID NO: 873 - DNA, 20 bp, Vaccinia Virus
ttaaatgtttgggttcatac

SEQ ID NO: 874 - DNA, 20 bp, Vaccinia Virus
ttcccctccaccaaacccca

SEQ ID NO: 875 - DNA, 24 bp, Vaccinia Virus
acaaacctcgaaacgaacagttaa

SEQ ID NO: 876 - DNA, 21 bp, Vaccinia Virus
ctatggacaaggaagaatagt

SEQ ID NO: 877 - DNA, 20 bp, Vaccinia Virus
tatgaatcatacatacactc

SEQ ID NO: 878 - DNA, 19 bp, Vaccinia Virus
gataccaaaaagttgcaat

SEQ ID NO: 879 - DNA, 21 bp, Vaccinia Virus
aaacaatgcagtacaggacat

SEQ ID NO: 880 - DNA, 19 bp, Vaccinia Virus
attgaaaggagagcaacgg

SEQ ID NO: 881 - DNA, 19 bp, Vaccinia Virus
tctccagatgagagtacac

SEQ ID NO: 882 - DNA, 19 bp, Vaccinia Virus
tctccagatgagagtacac

SEQ ID NO: 883 - DNA, 19 bp, Vaccinia Virus
tctccagatgagagtacac

SEQ ID NO: 884 - DNA, 21 bp, Vaccinia Virus
atatttttgtggctgcttttt

SEQ ID NO: 885 - DNA, 24 bp, Vaccinia Virus
taaataattttataattcaacaaa

SEQ ID NO: 886 - DNA, 19 bp, Vaccinia Virus
tataaagaacccagttcca

SEQ ID NO: 887 - DNA, 18 bp, Vaccinia Virus
aatggcgttttataaatt

SEQ ID NO: 888 - DNA, 20 bp, Vaccinia Virus
ctcttaaaaagatgctatgc

SEQ ID NO: 889 - DNA, 21 bp, Vaccinia Virus
gcatcagtgtttttcaactcc

SEQ ID NO: 890 - DNA, 19 bp, Vaccinia Virus
agccacagaaagcaagccg

SEQ ID NO: 891 - DNA, 18 bp, Vaccinia Virus
aggactttctgtgccaca

SEQ ID NO: 892 - DNA, 20 bp, Vaccinia Virus
aggctgggctgagccaaagc

SEQ ID NO: 893 - DNA, 17 bp, Vaccinia Virus
tattttccttctctctc

SEQ ID NO: 894 - DNA, 20 bp, Vaccinia Virus
gctaatgaagaaaacttctc

SEQ ID NO: 895 - DNA, 19 bp, Vaccinia Virus
ggaataaagttttatcaaa

SEQ ID NO: 896 - DNA, 21 bp, Vaccinia Virus
agacacatggctatcctagag

SEQ ID NO: 897 - DNA, 19 bp, Vaccinia Virus
tggtaagaaggatatttaa

SEQ ID NO: 898 - DNA, 19 bp, Vaccinia Virus
gaggagccactgccaaact

SEQ ID NO: 899 - DNA, 18 bp, Vaccinia Virus
attctcccttctctcttt

SEQ ID NO: 900 - DNA, 18 bp, Vaccinia Virus
tccttccccaatcacctt

SEQ ID NO: 901 - DNA, 23 bp, Vaccinia Virus
gttctgttgtttttatagcaggg

SEQ ID NO: 902 - DNA, 19 bp, Vaccinia Virus
attttgtgaatggattgga

SEQ ID NO: 903 - DNA, 25 bp, Vaccinia Virus
tctcacacacacacaggcccataga

SEQ ID NO: 904 - DNA, 21 bp, Vaccinia Virus
actagaacaacccaaatagca

SEQ ID NO: 905 - DNA, 18 bp, Vaccinia Virus
gtcagaaactgccatttg

SEQ ID NO: 906 - DNA, 16 bp, Vaccinia Virus
tctattttgccacaag

SEQ ID NO: 907 - DNA, 18 bp, Vaccinia Virus
tgtgaaattctgtccaaa

SEQ ID NO: 908 - DNA, 20 bp, Vaccinia Virus
tagaaatggagagtttaata

SEQ ID NO: 909 - DNA, 16 bp, Vaccinia Virus
agtaaatgtcctgcta

SEQ ID NO: 910 - DNA, 18 bp, Vaccinia Virus
atcttgtttcacactagt

SEQ ID NO: 911 - DNA, 15 bp, Vaccinia Virus
tctgcatctgtccac

SEQ ID NO: 912 - DNA, 19 bp, Vaccinia Virus
caggaacaaaacactgcct

SEQ ID NO: 913 - DNA, 19 bp, Vaccinia Virus
gctaaaaacactcatccta

SEQ ID NO: 914 - DNA, 21 bp, Vaccinia Virus
aggatatttaagaaaatacaa

SEQ ID NO: 915 - DNA, 18 bp, Vaccinia Virus
tcccctccctacctcatg

SEQ ID NO: 916 - DNA, 22 bp, Vaccinia Virus
atttatttaaccaatgacctta

SEQ ID NO: 917 - DNA, 15 bp, Vaccinia Virus
cgttggaagagtctt

SEQ ID NO: 918 - DNA, 22 bp, Vaccinia Virus
ccccatacaccatctattccat

SEQ ID NO: 919 - DNA, 24 bp, Vaccinia Virus
aagtatagtgactcagaatcctca

SEQ ID NO: 920 - DNA, 27 bp, Vaccinia Virus
aacaagcctccttttaaagtaacccta

SEQ ID NO: 921 - DNA, 19 bp, Vaccinia Virus
tagctccttttgaccttca

SEQ ID NO: 922 - DNA, 20 bp, Vaccinia Virus
tatctctgtttccttttaca

SEQ ID NO: 923 - DNA, 18 bp, Vaccinia Virus
ccattccatggaaataaa

SEQ ID NO: 924 - DNA, 24 bp, Vaccinia Virus
ttaaatatgcatctggcccaggaa

SEQ ID NO: 925 - DNA, 18 bp, Vaccinia Virus
atgccaactcttaagatt

SEQ ID NO: 926 - DNA, 23 bp, Vaccinia Virus
ttttttttctctctctctctctc

SEQ ID NO: 927 - DNA, 16 bp, Vaccinia Virus
agccacaggagatgtc

SEQ ID NO: 928 - DNA, 21 bp, Vaccinia Virus
aaatgaaagtgatgatactgt

SEQ ID NO: 929 - DNA, 18 bp, Vaccinia Virus
tatttttggtttctctct

SEQ ID NO: 930 - DNA, 18 bp, Vaccinia Virus
tcagcatttttattccca

SEQ ID NO: 931 - DNA, 20 bp, Vaccinia Virus
aaaatactacatctttctgg

SEQ ID NO: 932 - DNA, 17 bp, Vaccinia Virus
cgtgtctttgtgctgtg

SEQ ID NO: 933 - DNA, 19 bp, Vaccinia Virus
accaaaactgcaatcagga

SEQ ID NO: 934 - DNA, 23 bp, Vaccinia Virus
tggaaaagaaaaccctgtaggca

SEQ ID NO: 935 - DNA, 18 bp, Vaccinia Virus
tctcataaatgggtggga

SEQ ID NO: 936 - DNA, 20 bp, Vaccinia Virus
gatgcaaacattggaagatt

SEQ ID NO: 937 - DNA, 24 bp, Vaccinia Virus
acattcattgaattattatcactg

SEQ ID NO: 938 - DNA, 22 bp, Vaccinia Virus
aaacagtattaatgcagaaatg

SEQ ID NO: 939 - DNA, 18 bp, Vaccinia Virus
tattttttttctctattc

SEQ ID NO: 940 - DNA, 24 bp, Vaccinia Virus
gccatgcaattcatcccagaggaa

SEQ ID NO: 941 - DNA, 18 bp, Vaccinia Virus
ctgggagaaggtctccaa

SEQ ID NO: 942 - DNA, 20 bp, Vaccinia Virus
aagcagaaaacaaaaacaac

SEQ ID NO: 943 - DNA, 20 bp, Vaccinia Virus
gcaatgctatccattgatgt

SEQ ID NO: 944 - DNA, 26 bp, Vaccinia Virus
tgtccatataccagatttaaaatatt

SEQ ID NO: 945 - DNA, 18 bp, Vaccinia Virus
aagtaattttttcaaaga

SEQ ID NO: 946 - DNA, 19 bp, Vaccinia Virus
agatgagaactggtggtta

SEQ ID NO: 947 - DNA, 19 bp, Vaccinia Virus
taatagcctactattgacc

SEQ ID NO: 948 - DNA, 20 bp, Vaccinia Virus
tgccaagaagattccttcta

SEQ ID NO: 949 - DNA, 23 bp, Vaccinia Virus
gccatttgacaccctttatgatg

SEQ ID NO: 950 - DNA, 18 bp, Vaccinia Virus
attcgttttctctctctc

SEQ ID NO: 951 - DNA, 24 bp, Vaccinia Virus
ggaaaagagagctctctacatgaa

SEQ ID NO: 952 - DNA, 18 bp, Vaccinia Virus
tatttttcttctcccttt

SEQ ID NO: 953 - DNA, 19 bp, Vaccinia Virus
tctaacgaattaccacaaa

SEQ ID NO: 954 - DNA, 23 bp, Vaccinia Virus
gcaatcagtaaaacattgagctc

SEQ ID NO: 955 - DNA, 25 bp, Vaccinia Virus
aaaaaactccatgttattggactaa

SEQ ID NO: 956 - DNA, 22 bp, Vaccinia Virus
tgactttcttctcaaacctgga

SEQ ID NO: 957 - DNA, 17 bp, Vaccinia Virus
tagccacagacatgctg

SEQ ID NO: 958 - DNA, 18 bp, Vaccinia Virus
tttgctctctttctccct

SEQ ID NO: 959 - DNA, 18 bp, Vaccinia Virus
tttgctctctttctccct

SEQ ID NO: 960 - DNA, 22 bp, Vaccinia Virus
ttgcatcaagggctttatcaaa

SEQ ID NO: 961 - DNA, 21 bp, Vaccinia Virus
caaacaaggctcaaaattctc

SEQ ID NO: 962 - DNA, 19 bp, Vaccinia Virus
agataaacacaaaatccat

SEQ ID NO: 963 - DNA, 18 bp, Vaccinia Virus
atgcaaaactcaacgatc

SEQ ID NO: 964 - DNA, 19 bp, Vaccinia Virus
gaagcaccgggaagactta

SEQ ID NO: 965 - DNA, 17 bp, Vaccinia Virus
cccctctttcacttcat

SEQ ID NO: 966 - DNA, 25 bp, Vaccinia Virus
agaatggaaataaaactcaatatta

SEQ ID NO: 967 - DNA, 18 bp, Vaccinia Virus
acctgcaactgtaatttg

SEQ ID NO: 968 - DNA, 21 bp, Vaccinia Virus
ttttgaactacagatgttgta

SEQ ID NO: 969 - DNA, 20 bp, Vaccinia Virus
tattttcttttcctctcttt

SEQ ID NO: 970 - DNA, 20 bp, Vaccinia Virus
gaaaggtgttcttacatgaa

SEQ ID NO: 971 - DNA, 18 bp, Vaccinia Virus
tagagattaaaccaatta

SEQ ID NO: 972 - DNA, 18 bp, Vaccinia Virus
tgaagcccgctgtgttca

SEQ ID NO: 973 - DNA, 17 bp, Vaccinia Virus
gctggtgagccagtggc

SEQ ID NO: 974 - DNA, 23 bp, Vaccinia Virus
catcaaagccaaaaggacctaca

SEQ ID NO: 975 - DNA, 24 bp, Vaccinia Virus
gaagaggaattaaaatatacagga

SEQ ID NO: 976 - DNA, 22 bp, Vaccinia Virus
cagaaacagtattttcttccca

SEQ ID NO: 977 - DNA, 21 bp, Vaccinia Virus
ctaatgttatttcttaaaatt

SEQ ID NO: 978 - DNA, 20 bp, Vaccinia Virus
ctttaaaataaaatgcagac

SEQ ID NO: 979 - DNA, 22 bp, Vaccinia Virus
ttcccctcactatcctacccca

SEQ ID NO: 980 - DNA, 19 bp, Vaccinia Virus
tggtaatacaatactgata

SEQ ID NO: 981 - DNA, 21 bp, Vaccinia Virus
acaaagtttacatttcatact

SEQ ID NO: 982 - DNA, 18 bp, Vaccinia Virus
tcccttccccactccatg

SEQ ID NO: 983 - DNA, 20 bp, Vaccinia Virus
gactgaaaagaaattctcca

SEQ ID NO: 984 - DNA, 17 bp, Vaccinia Virus
tagtcacagaactgctg

SEQ ID NO: 985 - DNA, 18 bp, Vaccinia Virus
tcatgtggagtgaaaggc

SEQ ID NO: 986 - DNA, 19 bp, Vaccinia Virus
aggggattggaaacatcgt

SEQ ID NO: 987 - DNA, 22 bp, Vaccinia Virus
ataaaaagggacatgaaaatga

SEQ ID NO: 988 - DNA, 16 bp, Vaccinia Virus
ttgccatcctgcttct

SEQ ID NO: 989 - DNA, 18 bp, Vaccinia Virus
gtgactgtaaactctatg

SEQ ID NO: 990 - DNA, 18 bp, Vaccinia Virus
taacttcatgaagactta

SEQ ID NO: 991 - DNA, 18 bp, Vaccinia Virus
aatcataatcatctgata

SEQ ID NO: 992 - DNA, 24 bp, Vaccinia Virus
gtctcactgtttgatcaaacttct

SEQ ID NO: 993 - DNA, 20 bp, Vaccinia Virus
agtaaatacaatttttaaaa

SEQ ID NO: 994 - DNA, 18 bp, Vaccinia Virus
agtcacaatcatcatgtc

SEQ ID NO: 995 - DNA, 18 bp, Vaccinia Virus
taatgtagagataaaagc

SEQ ID NO: 996 - DNA, 18 bp, Vaccinia Virus
tattacactgtatttgta

SEQ ID NO: 997 - DNA, 19 bp, Vaccinia Virus
agaaagtttgacaaaaata

SEQ ID NO: 998 - DNA, 17 bp, Vaccinia Virus
taagggaatcccttgta

SEQ ID NO: 999 - DNA, 16 bp, Vaccinia Virus
ccaatatatcttctca

SEQ ID NO: 1000 - DNA, 18 bp, Vaccinia Virus
ctagatcaacagatcaac

SEQ ID NO: 1001 - DNA, 24 bp, Vaccinia Virus
ggaaactgtttaatatcacatgaa

SEQ ID NO: 1002 - DNA, 22 bp, Vaccinia Virus
aatgcctgtatataaatatgaa

SEQ ID NO: 1003 - DNA, 18 bp, Vaccinia Virus
tttcttctagttctttct

SEQ ID NO: 1004 - DNA, 18 bp, Vaccinia Virus
taatgtttgcacactgaa

SEQ ID NO: 1005 - DNA, 21 bp, Vaccinia Virus
tctggtgatggtttccacagg

SEQ ID NO: 1006 - DNA, 18 bp, Vaccinia Virus
atttattcttggtgaaga

SEQ ID NO: 1007 - DNA, 22 bp, Vaccinia Virus
aggaccgttcacatacaaagaa

SEQ ID NO: 1008 - DNA, 18 bp, Vaccinia Virus
atatgctaaacaaaagaa

SEQ ID NO: 1009 - DNA, 21 bp, Vaccinia Virus
atcaacaaaagggagaacatg

SEQ ID NO: 1010 - DNA, 22 bp, Vaccinia Virus
aataaatgttgaaaccaactga

SEQ ID NO: 1011 - DNA, 18 bp, Vaccinia Virus
agttgcgaaaccatgtcg

SEQ ID NO: 1012 - DNA, 21 bp, Vaccinia Virus
ccgtgttggcggccgcagcgg

SEQ ID NO: 1013 - DNA, 16 bp, Vaccinia Virus
tgtgagctttatcaga

SEQ ID NO: 1014 - DNA, 16 bp, Vaccinia Virus
ctgcaagggacgagtc

SEQ ID NO: 1015 - DNA, 19 bp, Vaccinia Virus
ctgggtccacatcctgcta

SEQ ID NO: 1016 - DNA, 16 bp, Vaccinia Virus
acctgatgtgtacatc

SEQ ID NO: 1017 - DNA, 23 bp, Vaccinia Virus
cgaatcaaaacaacccccacaca

SEQ ID NO: 1018 - DNA, 23 bp, Vaccinia Virus
ctttgatgtattctagtttatct

SEQ ID NO: 1019 - DNA, 21 bp, Vaccinia Virus
cagctgggcgcccactctcct

SEQ ID NO: 1020 - DNA, 18 bp, Vaccinia Virus
ccaagaaagctaactcct

SEQ ID NO: 1021 - DNA, 18 bp, Vaccinia Virus
gaaaatcatgaaatgcct

SEQ ID NO: 1022 - DNA, 19 bp, Vaccinia Virus
tggtgagaaacccaacaaa

SEQ ID NO: 1023 - DNA, 19 bp, Vaccinia Virus
gcttacattgctatttgta

SEQ ID NO: 1024 - DNA, 21 bp, Vaccinia Virus
atttttcttttgtttctctct

SEQ ID NO: 1025 - DNA, 21 bp, Vaccinia Virus
atttttcttttgtttctctct

SEQ ID NO: 1026 - DNA, 19 bp, Vaccinia Virus
tctccccctttctctcttc

SEQ ID NO: 1027 - DNA, 23 bp, Vaccinia Virus
ctaatgaattgagcacatctaat

SEQ ID NO: 1028 - DNA, 26 bp, Vaccinia Virus
caggagtgggttgatttcagcaccta

SEQ ID NO: 1029 - DNA, 20 bp, Vaccinia Virus
ctagagcactgccaccagta

SEQ ID NO: 1030 - DNA, 19 bp, Vaccinia Virus
tgactatggataaactaaa

SEQ ID NO: 1031 - DNA, 18 bp, Vaccinia Virus
taatgcttggaatgggag

SEQ ID NO: 1032 - DNA, 22 bp, Vaccinia Virus
acctactaatagtttgttgatc

SEQ ID NO: 1033 - DNA, 21 bp, Vaccinia Virus
gaaaaaaaaagcttgtggcca

SEQ ID NO: 1034 - DNA, 16 bp, Vaccinia Virus
tctgttgctactaagc

SEQ ID NO: 1035 - DNA, 25 bp, Vaccinia Virus
aatggtttttgttttaacaatatta

SEQ ID NO: 1036 - DNA, 18 bp, Vaccinia Virus
atgaatgaaaatacatct

SEQ ID NO: 1037 - DNA, 19 bp, Vaccinia Virus
cagaacactcctatttgta

SEQ ID NO: 1038 - DNA, 21 bp, Vaccinia Virus
ccatagtgcacatattccagg

SEQ ID NO: 1039 - DNA, 20 bp, Vaccinia Virus
tttgctgataaatttgcagt

SEQ ID NO: 1040 - DNA, 19 bp, Vaccinia Virus
agttgggtaacaaaaatgg

SEQ ID NO: 1041 - DNA, 21 bp, Vaccinia Virus
ggaaaactgaagactttaata

SEQ ID NO: 1042 - DNA, 18 bp, Vaccinia Virus
ggtaatttatagaacaaa

SEQ ID NO: 1043 - DNA, 22 bp, Vaccinia Virus
tagaacaatagaaactttaata

SEQ ID NO: 1044 - DNA, 20 bp, Vaccinia Virus
aatatagatattttatatac

SEQ ID NO: 1045 - DNA, 16 bp, Vaccinia Virus
ttggaaatcagttgtg

SEQ ID NO: 1046 - DNA, 22 bp, Vaccinia Virus
tgtgatatttctttgtgccaaa

SEQ ID NO: 1047 - DNA, 22 bp, Vaccinia Virus
aggacccttataggtactcaca

SEQ ID NO: 1048 - DNA, 18 bp, Vaccinia Virus
tgacagtgcagtgcaaac

SEQ ID NO: 1049 - DNA, 21 bp, Vaccinia Virus
aagatgtgaccactacatgta

SEQ ID NO: 1050 - DNA, 21 bp, Vaccinia Virus
catgggtagctacccaataag

SEQ ID NO: 1051 - DNA, 21 bp, Vaccinia Virus
ccatctaatgtgattgctaag

SEQ ID NO: 1052 - DNA, 21 bp, Vaccinia Virus
tcccactccctacttctgcca

SEQ ID NO: 1053 - DNA, 22 bp, Vaccinia Virus
ttgctgagaaggcttcattaaa

SEQ ID NO: 1054 - DNA, 23 bp, Vaccinia Virus
tatttttattctcttaagtcttt

SEQ ID NO: 1055 - DNA, 22 bp, Vaccinia Virus
tgtgacttttatggaattaaga

SEQ ID NO: 1056 - DNA, 18 bp, Vaccinia Virus
gaagattacagttatgta

SEQ ID NO: 1057 - DNA, 24 bp, Vaccinia Virus
gctggtgtaaacaaacctactaca

SEQ ID NO: 1058 - DNA, 19 bp, Vaccinia Virus
tactacactgccagttgta

SEQ ID NO: 1059 - DNA, 20 bp, Vaccinia Virus
ttttgtaaaacttttttttc

SEQ ID NO: 1060 - DNA, 21 bp, Vaccinia Virus
cctgcctatcctctccgatca

SEQ ID NO: 1061 - DNA, 18 bp, Vaccinia Virus
tcagcaccattattccca

SEQ ID NO: 1062 - DNA, 18 bp, Vaccinia Virus
atttattctgagcctgag

SEQ ID NO: 1063 - DNA, 21 bp, Vaccinia Virus
tatgaatgaaaacaaaacacc

SEQ ID NO: 1064 - DNA, 21 bp, Vaccinia Virus
aataaagaaaaaaaatctcca

SEQ ID NO: 1065 - DNA, 20 bp, Vaccinia Virus
tttataggtagttgtttaca

SEQ ID NO: 1066 - DNA, 19 bp, Vaccinia Virus
gtcatattaagaaacacct

SEQ ID NO: 1067 - DNA, 19 bp, Vaccinia Virus
tctgcatccatttgaacac

SEQ ID NO: 1068 - DNA, 18 bp, Vaccinia Virus
ctaatgaaaaactgctta

SEQ ID NO: 1069 - DNA, 17 bp, Vaccinia Virus
gaaattagtgtggggaa

SEQ ID NO: 1070 - DNA, 16 bp, Vaccinia Virus
gttggatcaactaatg

SEQ ID NO: 1071 - DNA, 21 bp, Vaccinia Virus
gaaaggacagttttacatgaa

SEQ ID NO: 1072 - DNA, 23 bp, Vaccinia Virus
tgtgcaattacgtccaccaaaga

SEQ ID NO: 1073 - DNA, 18 bp, Vaccinia Virus
cagataatgcttccagtg

SEQ ID NO: 1074 - DNA, 18 bp, Vaccinia Virus
tggtgaaatcctatctct

SEQ ID NO: 1075 - DNA, 20 bp, Vaccinia Virus
aaacctttgaaattagcatt

SEQ ID NO: 1076 - DNA, 22 bp, Vaccinia Virus
aatatttttgtacctttctcct

SEQ ID NO: 1077 - DNA, 20 bp, Vaccinia Virus
gctaatgaaatgggaacctc

SEQ ID NO: 1078 - DNA, 18 bp, Vaccinia Virus
gtctgtttttgttcccga

SEQ ID NO: 1079 - DNA, 20 bp, Vaccinia Virus
gtgggtcatcccagcacctg

SEQ ID NO: 1080 - DNA, 20 bp, Vaccinia Virus
agcgttaacacaaaatccat

SEQ ID NO: 1081 - DNA, 20 bp, Vaccinia Virus
actgtcaaagaatcaatcca

SEQ ID NO: 1082 - DNA, 28 bp, Vaccinia Virus
gacaaaattttctcattttcttttcact

SEQ ID NO: 1083 - DNA, 19 bp, Vaccinia Virus
tgatttactggaagacttg

SEQ ID NO: 1084 - DNA, 22 bp, Vaccinia Virus
gttctgttacccagggctctgc

SEQ ID NO: 1085 - DNA, 17 bp, Vaccinia Virus
gttgaaaagccaaaggt

SEQ ID NO: 1086 - DNA, 19 bp, Vaccinia Virus
ctaatgaaaaacattactc

SEQ ID NO: 1087 - DNA, 21 bp, Vaccinia Virus
tattgaggattgagccagtgc

SEQ ID NO: 1088 - DNA, 24 bp, Vaccinia Virus
ggacaccagagctgccgacttgga

SEQ ID NO: 1089 - DNA, 23 bp, Vaccinia Virus
atccactaaactggtcttcttca

SEQ ID NO: 1090 - DNA, 21 bp, Vaccinia Virus
tattgagccatgaataattta

SEQ ID NO: 1091 - DNA, 18 bp, Vaccinia Virus
gccacagaacacatacag

SEQ ID NO: 1092 - DNA, 19 bp, Vaccinia Virus
agatgagaagactagcagc

SEQ ID NO: 1093 - DNA, 17 bp, Vaccinia Virus
gctgataagataaaaaa

SEQ ID NO: 1094 - DNA, 20 bp, Vaccinia Virus
tgtgtgaaatttaaaaaagg

SEQ ID NO: 1095 - DNA, 20 bp, Vaccinia Virus
ccccttgctcccactccatg

SEQ ID NO: 1096 - DNA, 22 bp, Vaccinia Virus
ggacaccagaagacgattcaga

SEQ ID NO: 1097 - DNA, 20 bp, Vaccinia Virus
agaatggaaatttataatat

SEQ ID NO: 1098 - DNA, 17 bp, Vaccinia Virus
tggtgaactccacctcc

SEQ ID NO: 1099 - DNA, 21 bp, Vaccinia Virus
gaaaccttgacaggtacttca

SEQ ID NO: 1100 - DNA, 21 bp, Vaccinia Virus
atctctgtttctagatttagt

SEQ ID NO: 1101 - DNA, 20 bp, Vaccinia Virus
ggaggggacgctagtcgcgg

SEQ ID NO: 1102 - DNA, 20 bp, Vaccinia Virus
aacctccttgttttagacac

SEQ ID NO: 1103 - DNA, 16 bp, Vaccinia Virus
agccacagaagatgtc

SEQ ID NO: 1104 - DNA, 21 bp, Vaccinia Virus
aacagtcccagaatgacccca

SEQ ID NO: 1105 - DNA, 23 bp, Vaccinia Virus
ttcccctcacttaaccaccccat

SEQ ID NO: 1106 - DNA, 19 bp, Vaccinia Virus
tactgatggtactgttatt

SEQ ID NO: 1107 - DNA, 19 bp, Vaccinia Virus
acaaaggtcttcttttcct

SEQ ID NO: 1108 - DNA, 20 bp, Vaccinia Virus
ttctcataaaattgggcaca

SEQ ID NO: 1109 - DNA, 18 bp, Vaccinia Virus
tgcacgttaaaagttgac

SEQ ID NO: 1110 - DNA, 20 bp, Vaccinia Virus
cagctccgacgcagctcctc

SEQ ID NO: 1111 - DNA, 18 bp, Vaccinia Virus
gaaaagagttcttcagat

SEQ ID NO: 1112 - DNA, 19 bp, Vaccinia Virus
caataaatggtagctatta

SEQ ID NO: 1113 - DNA, 22 bp, Vaccinia Virus
tggaaaagaaaaactggtgcca

SEQ ID NO: 1114 - DNA, 19 bp, Vaccinia Virus
atttctggtaataagaagc

SEQ ID NO: 1115 - DNA, 19 bp, Vaccinia Virus
aaagcgacccattcagaga

SEQ ID NO: 1116 - DNA, 22 bp, Vaccinia Virus
ggacacggccctgcattctgga

SEQ ID NO: 1117 - DNA, 20 bp, Vaccinia Virus
tcccctctccacccacccca

SEQ ID NO: 1118 - DNA, 17 bp, Vaccinia Virus
ttcaatggacccacagg

SEQ ID NO: 1119 - DNA, 22 bp, Vaccinia Virus
agaaaaaatatgacttttttac

SEQ ID NO: 1120 - DNA, 21 bp, Vaccinia Virus
cctcttcctactggtctctct

SEQ ID NO: 1121 - DNA, 22 bp, Vaccinia Virus
cagttgaacccagcagcccgcc

SEQ ID NO: 1122 - DNA, 21 bp, Vaccinia Virus
acaaattctattgaagtattt

SEQ ID NO: 1123 - DNA, 20 bp, Vaccinia Virus
ttagtggttatttctaaaat

SEQ ID NO: 1124 - DNA, 19 bp, Vaccinia Virus
gccaatggagactgtctca

SEQ ID NO: 1125 - DNA, 19 bp, Vaccinia Virus
aaagttcggggaaaatacc

SEQ ID NO: 1126 - DNA, 22 bp, Vaccinia Virus
caagatcatagtatttcagtca

SEQ ID NO: 1127 - DNA, 18 bp, Vaccinia Virus
tgccaagagcctgcccct

SEQ ID NO: 1128 - DNA, 19 bp, Vaccinia Virus
actgtaattagaaaaatac

SEQ ID NO: 1129 - DNA, 18 bp, Vaccinia Virus
atctctgtctttaccagc

SEQ ID NO: 1130 - DNA, 23 bp, Vaccinia Virus
atattttctcaatcttaggagga

SEQ ID NO: 1131 - DNA, 22 bp, Vaccinia Virus
tgttttaaaaaggaactgcagc

SEQ ID NO: 1132 - DNA, 20 bp, Vaccinia Virus
ttctcatagacgtcctgaga

SEQ ID NO: 1133 - DNA, 23 bp, Vaccinia Virus
aaagaaataggttcacaacagga

SEQ ID NO: 1134 - DNA, 18 bp, Vaccinia Virus
atttctgggagcatttac

SEQ ID NO: 1135 - DNA, 19 bp, Vaccinia Virus
ttctatccttctacccaaa

SEQ ID NO: 1136 - DNA, 21 bp, Vaccinia Virus
tacacttggggagatttgcca

SEQ ID NO: 1137 - DNA, 16 bp, Vaccinia Virus
gttctttgaagactta

SEQ ID NO: 1138 - DNA, 22 bp, Vaccinia Virus
gcgtggggttttttaatctctg

SEQ ID NO: 1139 - DNA, 18 bp, Vaccinia Virus
tctcttatttctcttttc

SEQ ID NO: 1140 - DNA, 21 bp, Vaccinia Virus
aaaacagcagccctattcaga

SEQ ID NO: 1141 - DNA, 20 bp, Vaccinia Virus
tgcacagtagatgctatgga

SEQ ID NO: 1142 - DNA, 18 bp, Vaccinia Virus
ctaatgaaaattattctc

SEQ ID NO: 1143 - DNA, 18 bp, Vaccinia Virus
tttattctcttcccttct

SEQ ID NO: 1144 - DNA, 20 bp, Vaccinia Virus
agcattctgagaaatgtcta

SEQ ID NO: 1145 - DNA, 19 bp, Vaccinia Virus
tgtccatagaaaaaatatt

SEQ ID NO: 1146 - DNA, 19 bp, Vaccinia Virus
agtcacagactgtcctgcc

SEQ ID NO: 1147 - DNA, 18 bp, Vaccinia Virus
ggaaaaaaggtttcacat

SEQ ID NO: 1148 - DNA, 18 bp, Vaccinia Virus
ttctgtgcccaccacaag

SEQ ID NO: 1149 - DNA, 18 bp, Vaccinia Virus
aaaggtatttgggcaaac

SEQ ID NO: 1150 - DNA, 21 bp, Vaccinia Virus
tagaaatagaacagcttaata

SEQ ID NO: 1151 - DNA, 21 bp, Vaccinia Virus
ccacttaataaaaatagaggc

SEQ ID NO: 1152 - DNA, 21 bp, Vaccinia Virus
ctgagcatatctctcgtaaca

SEQ ID NO: 1153 - DNA, 20 bp, Vaccinia Virus
ttggaaatttttctgttgaa

SEQ ID NO: 1154 - DNA, 20 bp, Vaccinia Virus
agtccaattaaaatatggaa

SEQ ID NO: 1155 - DNA, 18 bp, Vaccinia Virus
agtaataatttattccca

SEQ ID NO: 1156 - DNA, 20 bp, Vaccinia Virus
ctactgttatctctaaaatt

SEQ ID NO: 1157 - DNA, 18 bp, Vaccinia Virus
tagaacacaccttttcca

SEQ ID NO: 1158 - DNA, 20 bp, Vaccinia Virus
aaataaaaacaagtatctca

SEQ ID NO: 1159 - DNA, 18 bp, Vaccinia Virus
tgatagtgtctgcacaac

SEQ ID NO: 1160 - DNA, 16 bp, Vaccinia Virus
tagtcacaggagctgc

SEQ ID NO: 1161 - DNA, 18 bp, Vaccinia Virus
atctcagtctcaatcacc

SEQ ID NO: 1162 - DNA, 15 bp, Vaccinia Virus
ctaatgatcatctga

SEQ ID NO: 1163 - DNA, 25 bp, Vaccinia Virus
agaattcaagaacttgttacatgta

SEQ ID NO: 1164 - DNA, 21 bp, Vaccinia Virus
gaccccagcattatttctata

SEQ ID NO: 1165 - DNA, 17 bp, Vaccinia Virus
tccatagaatatattct

SEQ ID NO: 1166 - DNA, 24 bp, Vaccinia Virus
aatattatattttttctataaaaa

SEQ ID NO: 1167 - DNA, 21 bp, Vaccinia Virus
ccagagacaaatatttctaga

SEQ ID NO: 1168 - DNA, 20 bp, Vaccinia Virus
atggagtcccctctagggtt

SEQ ID NO: 1169 - DNA, 17 bp, Vaccinia Virus
agtgtcattttatttta

SEQ ID NO: 1170 - DNA, 19 bp, Vaccinia Virus
cagcatgccaacagtaata

SEQ ID NO: 1171 - DNA, 20 bp, Vaccinia Virus
atcagcatgaaaacatccta

SEQ ID NO: 1172 - DNA, 19 bp, Vaccinia Virus
gctaatgacctggctttca

SEQ ID NO: 1173 - DNA, 19 bp, Vaccinia Virus
gtacacacagtgactatta

SEQ ID NO: 1174 - DNA, 20 bp, Vaccinia Virus
tagaagaaaaatgtacctta

SEQ ID NO: 1175 - DNA, 16 bp, Vaccinia Virus
tgttggttgtaccaaa

SEQ ID NO: 1176 - DNA, 22 bp, Vaccinia Virus
agccagacaaaatttgagaata

SEQ ID NO: 1177 - DNA, 21 bp, Vaccinia Virus
gccacggaaacatacagagga

SEQ ID NO: 1178 - DNA, 23 bp, Vaccinia Virus
taagggaagatcactgtagttta

SEQ ID NO: 1179 - DNA, 24 bp, Vaccinia Virus
caagaaaatttaaaacgatcccaa

SEQ ID NO: 1180 - DNA, 18 bp, Vaccinia Virus
catgtgtattaatgtcta

SEQ ID NO: 1181 - DNA, 16 bp, Vaccinia Virus
gagaaagagagagata

SEQ ID NO: 1182 - DNA, 22 bp, Vaccinia Virus
attggtcatcttccctatcaca

SEQ ID NO: 1183 - DNA, 15 bp, Vaccinia Virus
ctgttggtgtgctgc

SEQ ID NO: 1184 - DNA, 19 bp, Vaccinia Virus
ttcccctctattgttcccc

SEQ ID NO: 1185 - DNA, 18 bp, Vaccinia Virus
tactacatgctttttgta

SEQ ID NO: 1186 - DNA, 20 bp, Vaccinia Virus
aatgttccatttttgttttc

SEQ ID NO: 1187 - DNA, 19 bp, Vaccinia Virus
tctctggaagaatttccaa

SEQ ID NO: 1188 - DNA, 21 bp, Vaccinia Virus
cgttagtaaacttacttcata

SEQ ID NO: 1189 - DNA, 15 bp, Vaccinia Virus
gcgaggagcatcaga

SEQ ID NO: 1190 - DNA, 19 bp, Vaccinia Virus
atatgccaaaaaatgagag

SEQ ID NO: 1191 - DNA, 18 bp, Vaccinia Virus
aggggacactggtaacat

SEQ ID NO: 1192 - DNA, 21 bp, Vaccinia Virus
ataatgtcttcagtggaacac

SEQ ID NO: 1193 - DNA, 18 bp, Vaccinia Virus
aaaggaagtgataaacta

SEQ ID NO: 1194 - DNA, 19 bp, Vaccinia Virus
ccccatcgcctactccatg

SEQ ID NO: 1195 - DNA, 23 bp, Vaccinia Virus
ctccacttggaatgggtaccaca

SEQ ID NO: 1196 - DNA, 18 bp, Vaccinia Virus
acaagaaaaaagattata

SEQ ID NO: 1197 - DNA, 21 bp, Vaccinia Virus
atgaagaataaactgatgcta

SEQ ID NO: 1198 - DNA, 19 bp, Vaccinia Virus
aaatgaaatgccaaaggaa

SEQ ID NO: 1199 - DNA, 24 bp, Vaccinia Virus
aggacaaatctaaaatgcaaagaa

SEQ ID NO: 1200 - DNA, 20 bp, Vaccinia Virus
ggtgacttgagcttgagctc

SEQ ID NO: 1201 - DNA, 17 bp, Vaccinia Virus
tgtttttaacatggatc

SEQ ID NO: 1202 - DNA, 21 bp, Vaccinia Virus
aataaacttgctgatgcattt

SEQ ID NO: 1203 - DNA, 21 bp, Vaccinia Virus
cttttacacgaccatttgata

SEQ ID NO: 1204 - DNA, 19 bp, Vaccinia Virus
tttgtggtagcttatctta

SEQ ID NO: 1205 - DNA, 19 bp, Vaccinia Virus
tatcttctgctctttcttc

SEQ ID NO: 1206 - DNA, 20 bp, Vaccinia Virus
aggacttttatgggctcggc

SEQ ID NO: 1207 - DNA, 18 bp, Vaccinia Virus
gctgcacaggaggccaga

SEQ ID NO: 1208 - DNA, 21 bp, Vaccinia Virus
cattaaaaagtgggcaaagga

SEQ ID NO: 1209 - DNA, 19 bp, Vaccinia Virus
atgatgaatttatcagcgt

SEQ ID NO: 1210 - DNA, 23 bp, Vaccinia Virus
tccttatggggatgggtgccaca

SEQ ID NO: 1211 - DNA, 19 bp, Vaccinia Virus
ataccattagaaaatacta

SEQ ID NO: 1212 - DNA, 18 bp, Vaccinia Virus
tctgcatctactgacttg

SEQ ID NO: 1213 - DNA, 20 bp, Vaccinia Virus
gagggccacactcttttcac

SEQ ID NO: 1214 - DNA, 22 bp, Vaccinia Virus
atttattttttagtgatgagaa

SEQ ID NO: 1215 - DNA, 19 bp, Vaccinia Virus
atagatgagaattttccgt

SEQ ID NO: 1216 - DNA, 21 bp, Vaccinia Virus
cagagaacactatttttacat

SEQ ID NO: 1217 - DNA, 24 bp, Vaccinia Virus
cagatgtggctactgacatatcta

SEQ ID NO: 1218 - DNA, 22 bp, Vaccinia Virus
tggaaaagtcggcttgtaatca

SEQ ID NO: 1219 - DNA, 20 bp, Vaccinia Virus
tggtggcagtaacatgcaac

SEQ ID NO: 1220 - DNA, 21 bp, Vaccinia Virus
atcaacaaatcttcactgagc

SEQ ID NO: 1221 - DNA, 20 bp, Vaccinia Virus
tggagtttgagactatggaa

SEQ ID NO: 1222 - DNA, 24 bp, Vaccinia Virus
aaagagtgaatgtggtatatttct

SEQ ID NO: 1223 - DNA, 24 bp, Vaccinia Virus
catgaggtaatattattattccca

SEQ ID NO: 1224 - DNA, 17 bp, Vaccinia Virus
tatttttaacatgaatc

SEQ ID NO: 1225 - DNA, 15 bp, Vaccinia Virus
cccctttctactcca

SEQ ID NO: 1226 - DNA, 20 bp, Vaccinia Virus
tgtccatacactttgttgca

SEQ ID NO: 1227 - DNA, 23 bp, Vaccinia Virus
aggccccagaatagctcctggac

SEQ ID NO: 1228 - DNA, 19 bp, Vaccinia Virus
gagaaaatgctttgtagaa

SEQ ID NO: 1229 - DNA, 20 bp, Vaccinia Virus
gtgactgtagttacttaaga

SEQ ID NO: 1230 - DNA, 18 bp, Vaccinia Virus
tagctccctgagctgcca

SEQ ID NO: 1231 - DNA, 21 bp, Vaccinia Virus
tgtcacttttttaaaacatga

SEQ ID NO: 1232 - DNA, 20 bp, Vaccinia Virus
actaaccctggtctttccca

SEQ ID NO: 1233 - DNA, 16 bp, Vaccinia Virus
gaaatggcctgtggaa

SEQ ID NO: 1234 - DNA, 17 bp, Vaccinia Virus
agaaagagaagtgtttt

SEQ ID NO: 1235 - DNA, 22 bp, Vaccinia Virus
ttctccacatgttgggtgtcca

SEQ ID NO: 1236 - DNA, 24 bp, Vaccinia Virus
gtcccagggagatattagacctct

SEQ ID NO: 1237 - DNA, 18 bp, Vaccinia Virus
gtggtcaaatatacatca

SEQ ID NO: 1238 - DNA, 18 bp, Vaccinia Virus
gatgggatttatcagtgt

SEQ ID NO: 1239 - DNA, 24 bp, Vaccinia Virus
aatatttgtattacttacaattaa

SEQ ID NO: 1240 - DNA, 17 bp, Vaccinia Virus
tgttgataaatccatca

SEQ ID NO: 1241 - DNA, 19 bp, Vaccinia Virus
atcagtggcttaaataata

SEQ ID NO: 1242 - DNA, 22 bp, Vaccinia Virus
actgaaataaaaatgacttcac

SEQ ID NO: 1243 - DNA, 21 bp, Vaccinia Virus
ttctgaaataatcagcagaaa

SEQ ID NO: 1244 - DNA, 22 bp, Vaccinia Virus
aggatatgatggttacaatgaa

SEQ ID NO: 1245 - DNA, 18 bp, Vaccinia Virus
atctctattctacattta

SEQ ID NO: 1246 - DNA, 20 bp, Vaccinia Virus
tcccctctgattcccccatg

SEQ ID NO: 1247 - DNA, 21 bp, Vaccinia Virus
ttctccacagcgggtgtcaca

SEQ ID NO: 1248 - DNA, 24 bp, Vaccinia Virus
aagcaaggtacccccaaagatgtt

SEQ ID NO: 1249 - DNA, 20 bp, Vaccinia Virus
cattaaaaagaaaccaggaa

SEQ ID NO: 1250 - DNA, 23 bp, Vaccinia Virus
aatgtgtttactctctttccttc

SEQ ID NO: 1251 - DNA, 21 bp, Vaccinia Virus
atttttatttttatgtctctc

SEQ ID NO: 1252 - DNA, 21 bp, Vaccinia Virus
atgattattccagatactgta

SEQ ID NO: 1253 - DNA, 24 bp, Vaccinia Virus
tctttaagtcgtgtttgtaaaaga

SEQ ID NO: 1254 - DNA, 19 bp, Vaccinia Virus
atgggaaaaaaaacataga

SEQ ID NO: 1255 - DNA, 23 bp, Vaccinia Virus
acaaaatgttatatagataatat

SEQ ID NO: 1256 - DNA, 22 bp, Vaccinia Virus
tttgccaagaaaaaaaattcta

SEQ ID NO: 1257 - DNA, 20 bp, Vaccinia Virus
agacatgggtgtgcacctta

SEQ ID NO: 1258 - DNA, 19 bp, Vaccinia Virus
agcccttctgtaaaatatg

SEQ ID NO: 1259 - DNA, 21 bp, Vaccinia Virus
ttggaaatatacagctctgtg

SEQ ID NO: 1260 - DNA, 18 bp, Vaccinia Virus
atgtgtaaatacatagaa

SEQ ID NO: 1261 - DNA, 17 bp, Vaccinia Virus
tctgagtagaaatgcgt

SEQ ID NO: 1262 - DNA, 22 bp, Vaccinia Virus
tggggcagaagagcccaactcc

SEQ ID NO: 1263 - DNA, 18 bp, Vaccinia Virus
tatgctacccttaataac

SEQ ID NO: 1264 - DNA, 20 bp, Vaccinia Virus
ctaatgaaatggatttccca

SEQ ID NO: 1265 - DNA, 19 bp, Vaccinia Virus
tgggacctaggctatctta

SEQ ID NO: 1266 - DNA, 20 bp, Vaccinia Virus
agcctaaacacaaaattcat

SEQ ID NO: 1267 - DNA, 22 bp, Vaccinia Virus
gttctgttgctatgaacacagc

SEQ ID NO: 1268 - DNA, 20 bp, Vaccinia Virus
gtgctgaaatccacgccaga

SEQ ID NO: 1269 - DNA, 18 bp, Vaccinia Virus
tagtcacactccctgccg

SEQ ID NO: 1270 - DNA, 26 bp, Vaccinia Virus
aaagaacaatataattttcacatgaa

SEQ ID NO: 1271 - DNA, 23 bp, Vaccinia Virus
tttttatctgcataaattttaca

SEQ ID NO: 1272 - DNA, 16 bp, Vaccinia Virus
tgcatgtgtccactta

SEQ ID NO: 1273 - DNA, 25 bp, Vaccinia Virus
ttgtgtagagttctaataccaaaga

SEQ ID NO: 1274 - DNA, 24 bp, Vaccinia Virus
ataattaatggtactcctataatt

SEQ ID NO: 1275 - DNA, 18 bp, Vaccinia Virus
gatggcttccgtgagaca

SEQ ID NO: 1276 - DNA, 25 bp, Vaccinia Virus
aacaaacaaaaactgttgctatttc

SEQ ID NO: 1277 - DNA, 21 bp, Vaccinia Virus
aatagtatttcagacactatg

SEQ ID NO: 1278 - DNA, 20 bp, Vaccinia Virus
gtgagaagccaggctagaga

SEQ ID NO: 1279 - DNA, 22 bp, Vaccinia Virus
ggaatcataatcatttgtattt

SEQ ID NO: 1280 - DNA, 22 bp, Vaccinia Virus
tctgaaataatgggattagaaa

SEQ ID NO: 1281 - DNA, 18 bp, Vaccinia Virus
tctgctataactctttca

SEQ ID NO: 1282 - DNA, 18 bp, Vaccinia Virus
ctgaaaatattgggcatc

SEQ ID NO: 1283 - DNA, 18 bp, Vaccinia Virus
agttgagagacaaaggta

SEQ ID NO: 1284 - DNA, 19 bp, Vaccinia Virus
aaaattgaaaacctctttc

SEQ ID NO: 1285 - DNA, 20 bp, Vaccinia Virus
taattggtagccatctcatg

SEQ ID NO: 1286 - DNA, 18 bp, Vaccinia Virus
aacagaaagatcatttga

SEQ ID NO: 1287 - DNA, 20 bp, Vaccinia Virus
ttggaaattaggagaaggaa

SEQ ID NO: 1288 - DNA, 22 bp, Vaccinia Virus
aattaatggtaacgatgatgct

SEQ ID NO: 1289 - DNA, 20 bp, Vaccinia Virus
ttcccctctaccctgcctcc

SEQ ID NO: 1290 - DNA, 17 bp, Vaccinia Virus
tccagttagaacattga

SEQ ID NO: 1291 - DNA, 18 bp, Vaccinia Virus
ggaaaaggaagaaagcca

SEQ ID NO: 1292 - DNA, 23 bp, Vaccinia Virus
tcctgtttcccacctccttctcc

SEQ ID NO: 1293 - DNA, 17 bp, Vaccinia Virus
aaaggtataattaaact

SEQ ID NO: 1294 - DNA, 17 bp, Vaccinia Virus
aaaggacgccacatgag

SEQ ID NO: 1295 - DNA, 19 bp, Vaccinia Virus
aactaactgtcaactgttg

SEQ ID NO: 1296 - DNA, 24 bp, Vaccinia Virus
tattgctgttctctccctttcttc

SEQ ID NO: 1297 - DNA, 22 bp, Vaccinia Virus
agagaaagacaactgttctgcg

SEQ ID NO: 1298 - DNA, 25 bp, Vaccinia Virus
ccacttacttagatatctgcagata

SEQ ID NO: 1299 - DNA, 21 bp, Vaccinia Virus
gttattcagttataagtaata

SEQ ID NO: 1300 - DNA, 15 bp, Vaccinia Virus
cccctctatatcctc

SEQ ID NO: 1301 - DNA, 19 bp, Vaccinia Virus
cactacaaacaaacaaacc

SEQ ID NO: 1302 - DNA, 20 bp, Vaccinia Virus
attgtaattatgaaatacct

SEQ ID NO: 1303 - DNA, 20 bp, Vaccinia Virus
cattaaatacatgccagaag

SEQ ID NO: 1304 - DNA, 25 bp, Vaccinia Virus
ttctacatcagatgttgtcacttat

SEQ ID NO: 1305 - DNA, 16 bp, Vaccinia Virus
aaatgaaaacagatca

SEQ ID NO: 1306 - DNA, 21 bp, Vaccinia Virus
accatatagaaaaagattata

SEQ ID NO: 1307 - DNA, 21 bp, Vaccinia Virus
ttcccctctctcattccccat

SEQ ID NO: 1308 - DNA, 20 bp, Vaccinia Virus
agagaaagcaggcttttcta

SEQ ID NO: 1309 - DNA, 22 bp, Vaccinia Virus
caaacaaagaaaaaattccaca

SEQ ID NO: 1310 - DNA, 23 bp, Vaccinia Virus
ggaaaggacctgccccacatgaa

SEQ ID NO: 1311 - DNA, 26 bp, Vaccinia Virus
gaaaagtacactttctactaaagatg

SEQ ID NO: 1312 - DNA, 19 bp, Vaccinia Virus
cctgccaggctctccaatc

SEQ ID NO: 1313 - DNA, 20 bp, Vaccinia Virus
caagatcataattttataga

SEQ ID NO: 1314 - DNA, 20 bp, Vaccinia Virus
gtgactgtaatatactagag

SEQ ID NO: 1315 - DNA, 15 bp, Vaccinia Virus
atatgccaaaaggaa

SEQ ID NO: 1316 - DNA, 18 bp, Vaccinia Virus
cattttaaaaataaaggc

SEQ ID NO: 1317 - DNA, 19 bp, Vaccinia Virus
cctgtttctcctccattca

SEQ ID NO: 1318 - DNA, 18 bp, Vaccinia Virus
tctccggatggaatcaca

SEQ ID NO: 1319 - DNA, 19 bp, Vaccinia Virus
atgatttgttccattttta

SEQ ID NO: 1320 - DNA, 21 bp, Vaccinia Virus
aagtagcagttcaaaagatgt

SEQ ID NO: 1321 - DNA, 28 bp, Vaccinia Virus
attctcacagatcagatcactccataga

SEQ ID NO: 1322 - DNA, 18 bp, Vaccinia Virus
ctccatttatgtacccac

SEQ ID NO: 1323 - DNA, 24 bp, Vaccinia Virus
aaagtgccattaacaaatgtatca

SEQ ID NO: 1324 - DNA, 18 bp, Vaccinia Virus
tgaagtatggtgtgttca

SEQ ID NO: 1325 - DNA, 21 bp, Vaccinia Virus
tccccagcatggatggccaca

SEQ ID NO: 1326 - DNA, 18 bp, Vaccinia Virus
tgtacagtcagtactata

SEQ ID NO: 1327 - DNA, 24 bp, Vaccinia Virus
ccaattatggaaacatacagtgga

SEQ ID NO: 1328 - DNA, 21 bp, Vaccinia Virus
acagagaaccaaaacagctaa

SEQ ID NO: 1329 - DNA, 22 bp, Vaccinia Virus
actgaaacacagcatggaatta

SEQ ID NO: 1330 - DNA, 17 bp, Vaccinia Virus
gaaaagacaaaggttac

SEQ ID NO: 1331 - DNA, 17 bp, Vaccinia Virus
taatggttggaacagaa

SEQ ID NO: 1332 - DNA, 18 bp, Vaccinia Virus
agacatggttgttgcacc

SEQ ID NO: 1333 - DNA, 22 bp, Vaccinia Virus
cgactcagcatacattttccca

SEQ ID NO: 1334 - DNA, 21 bp, Vaccinia Virus
caatgctgtatgatactattt

SEQ ID NO: 1335 - DNA, 18 bp, Vaccinia Virus
aacttgcattccactata

SEQ ID NO: 1336 - DNA, 18 bp, Vaccinia Virus
cgtactgggtgcaatgaa

SEQ ID NO: 1337 - DNA, 18 bp, Vaccinia Virus
tttgattcggatgttata

SEQ ID NO: 1338 - DNA, 17 bp, Vaccinia Virus
gtgttcatgaagactta

SEQ ID NO: 1339 - DNA, 19 bp, Vaccinia Virus
aaaggtatatgcaatgcta

SEQ ID NO: 1340 - DNA, 17 bp, Vaccinia Virus
gctaaaactgtagaagc

SEQ ID NO: 1341 - DNA, 20 bp, Vaccinia Virus
aaactgcaatttggttccac

SEQ ID NO: 1342 - DNA, 19 bp, Vaccinia Virus
gacaaatacattatttctg

SEQ ID NO: 1343 - DNA, 19 bp, Vaccinia Virus
gacatttttggcagagcat

SEQ ID NO: 1344 - DNA, 20 bp, Vaccinia Virus
cacttagaagttattgagga

SEQ ID NO: 1345 - DNA, 23 bp, Vaccinia Virus
atttaaataccccagccaagaaa

SEQ ID NO: 1346 - DNA, 19 bp, Vaccinia Virus
tttcttaaaatatattctg

SEQ ID NO: 1347 - DNA, 24 bp, Vaccinia Virus
gttaaatgttttctgtcttctgtt

SEQ ID NO: 1348 - DNA, 20 bp, Vaccinia Virus
agctcctgggccggccctca

SEQ ID NO: 1349 - DNA, 19 bp, Vaccinia Virus
aaaatattgaatgctttct

SEQ ID NO: 1350 - DNA, 22 bp, Vaccinia Virus
aaaattcatagtaatcctgcca

SEQ ID NO: 1351 - DNA, 20 bp, Vaccinia Virus
attggaaactgaaattcaga

SEQ ID NO: 1352 - DNA, 24 bp, Vaccinia Virus
tattttcacaactactttctctct

SEQ ID NO: 1353 - DNA, 18 bp, Vaccinia Virus
ttcaatagataccacgaa

SEQ ID NO: 1354 - DNA, 19 bp, Vaccinia Virus
gacatttttggcagagcat

SEQ ID NO: 1355 - DNA, 18 bp, Vaccinia Virus
atatttttaatcccgtta

SEQ ID NO: 1356 - DNA, 23 bp, Vaccinia Virus
tgatttatgataactatacattg

SEQ ID NO: 1357 - DNA, 18 bp, Vaccinia Virus
gatgccagagagaactta

SEQ ID NO: 1358 - DNA, 19 bp, Vaccinia Virus
ggacaccagaaaatttgta

SEQ ID NO: 1359 - DNA, 15 bp, Vaccinia Virus
actagcagaactctt

SEQ ID NO: 1360 - DNA, 25 bp, Vaccinia Virus
agatatgtttagtttagactttata

SEQ ID NO: 1361 - DNA, 18 bp, Vaccinia Virus
tccatttaaaatacattc

SEQ ID NO: 1362 - DNA, 21 bp, Vaccinia Virus
tctctgctgctggacccaaga

SEQ ID NO: 1363 - DNA, 18 bp, Vaccinia Virus
agaatggagacttataca

SEQ ID NO: 1364 - DNA, 20 bp, Vaccinia Virus
ctgacaaattaaggaggtta

SEQ ID NO: 1365 - DNA, 18 bp, Vaccinia Virus
aaacagtatcaatgttga

SEQ ID NO: 1366 - DNA, 18 bp, Vaccinia Virus
aggagaatcaattcttca

SEQ ID NO: 1367 - DNA, 18 bp, Vaccinia Virus
ttgaccaaaaattttaca

SEQ ID NO: 1368 - DNA, 18 bp, Vaccinia Virus
cgtgataaatatatggac

SEQ ID NO: 1369 - DNA, 19 bp, Vaccinia Virus
taatttcaaatagaatatg

SEQ ID NO: 1370 - DNA, 20 bp, Vaccinia Virus
caagatcataggcctcagac

SEQ ID NO: 1371 - DNA, 18 bp, Vaccinia Virus
tataataaattatgtgca

SEQ ID NO: 1372 - DNA, 18 bp, Vaccinia Virus
aaaaaaaatacatgggaa

SEQ ID NO: 1373 - DNA, 21 bp, Vaccinia Virus
aagcagttgagtaacagcaac

SEQ ID NO: 1374 - DNA, 21 bp, Vaccinia Virus
tgaagtgtagatttgtattta

SEQ ID NO: 1375 - DNA, 19 bp, Vaccinia Virus
cgttaggaatccattctca

SEQ ID NO: 1376 - DNA, 21 bp, Vaccinia Virus
tgtaactcaagcatcaattca

SEQ ID NO: 1377 - DNA, 19 bp, Vaccinia Virus
aaaaaaagttacagaaata

SEQ ID NO: 1378 - DNA, 19 bp, Vaccinia Virus
aaaaaaagttacagaaata

SEQ ID NO: 1379 - DNA, 19 bp, Vaccinia Virus
aaaaaaagttacagaaata

SEQ ID NO: 1380 - DNA, 23 bp, Vaccinia Virus
gccatgagcacaaaattatggta

SEQ ID NO: 1381 - DNA, 23 bp, Vaccinia Virus
gccatgagcacaaaattatggta

SEQ ID NO: 1382 - DNA, 23 bp, Vaccinia Virus
gccatgagcacaaaattatggta

SEQ ID NO: 1383 - DNA, 23 bp, Vaccinia Virus
gccatgagcacaaaattatggta

SEQ ID NO: 1384 - DNA, 23 bp, Vaccinia Virus
gccatgagcacaaaattatggta

SEQ ID NO: 1385 - DNA, 23 bp, Vaccinia Virus
gccatgagcacaaaattatggta

SEQ ID NO: 1386 - DNA, 23 bp, Vaccinia Virus
gccatgagcacaaaattatggta

SEQ ID NO: 1387 - DNA, 23 bp, Vaccinia Virus
gccatgagcacaaaattatggta

SEQ ID NO: 1388 - DNA, 23 bp, Vaccinia Virus
gccatgagcacaaaattatggta

SEQ ID NO: 1389 - DNA, 23 bp, Vaccinia Virus
gccatgagcacaaaattatggta

SEQ ID NO: 1390 - DNA, 18 bp, Vaccinia Virus
ctaatgaagtgggctcca

SEQ ID NO: 1391 - DNA, 23 bp, Vaccinia Virus
gccatgagcacaaaattatggta

SEQ ID NO: 1392 - DNA, 22 bp, Vaccinia Virus
tggaagttagcactctagggaa

SEQ ID NO: 1393 - DNA, 17 bp, Vaccinia Virus
ttctactttgccacaga

SEQ ID NO: 1394 - DNA, 19 bp, Vaccinia Virus
aaaggtatatgtgataaat

SEQ ID NO: 1395 - DNA, 17 bp, Vaccinia Virus
aagggaatttttttgta

SEQ ID NO: 1396 - DNA, 20 bp, Vaccinia Virus
cctgaatgaatgggtgtcac

SEQ ID NO: 1397 - DNA, 16 bp, Vaccinia Virus
agtcacagaaggttcc

SEQ ID NO: 1398 - DNA, 21 bp, Vaccinia Virus
gtgtgagattcgtaccgaaga

SEQ ID NO: 1399 - DNA, 18 bp, Vaccinia Virus
tgtgtgaaatctttcaag

SEQ ID NO: 1400 - DNA, 19 bp, Vaccinia Virus
aaaactagtatgtggaaag

SEQ ID NO: 1401 - DNA, 18 bp, Vaccinia Virus
gacctctatatcctggtg

SEQ ID NO: 1402 - DNA, 18 bp, Vaccinia Virus
ttccatcctcatcacaag

SEQ ID NO: 1403 - DNA, 20 bp, Vaccinia Virus
atttattctgaacgggagaa

SEQ ID NO: 1404 - DNA, 22 bp, Vaccinia Virus
tattcccagcctttctttcttc

SEQ ID NO: 1405 - DNA, 19 bp, Vaccinia Virus
agaacagagattttacagt

SEQ ID NO: 1406 - DNA, 17 bp, Vaccinia Virus
ttctcatagattttgta

SEQ ID NO: 1407 - DNA, 20 bp, Vaccinia Virus
ctgccaagcctggtctgtca

SEQ ID NO: 1408 - DNA, 19 bp, Vaccinia Virus
ataatggtaataggaaaac

SEQ ID NO: 1409 - DNA, 20 bp, Vaccinia Virus
aggtgaaaggcatctttctg

SEQ ID NO: 1410 - DNA, 17 bp, Vaccinia Virus
tagtcacagtaatcccc

SEQ ID NO: 1411 - DNA, 22 bp, Vaccinia Virus
atattgtagaaggaaacaccaa

SEQ ID NO: 1412 - DNA, 18 bp, Vaccinia Virus
aagggatcagaaattcaa

SEQ ID NO: 1413 - DNA, 19 bp, Vaccinia Virus
tgccctcaagcttatacta

SEQ ID NO: 1414 - DNA, 19 bp, Vaccinia Virus
ttattcctctctgtccaca

SEQ ID NO: 1415 - DNA, 17 bp, Vaccinia Virus
tcctgtttcccacccag

SEQ ID NO: 1416 - DNA, 24 bp, Vaccinia Virus
ctatagatgatattttaaattgaa

SEQ ID NO: 1417 - DNA, 22 bp, Vaccinia Virus
aaaatactagcttattttctga

SEQ ID NO: 1418 - DNA, 19 bp, Vaccinia Virus
ttctgggtctgatctgtca

SEQ ID NO: 1419 - DNA, 18 bp, Vaccinia Virus
agatctagttttatctta

SEQ ID NO: 1420 - DNA, 18 bp, Vaccinia Virus
tattctcttttttttctc

SEQ ID NO: 1421 - DNA, 21 bp, Vaccinia Virus
ccacaagcatacctattaaga

SEQ ID NO: 1422 - DNA, 19 bp, Vaccinia Virus
gtgaggaagactttaccaa

SEQ ID NO: 1423 - DNA, 21 bp, Vaccinia Virus
agatgcaaatgtattactgta

SEQ ID NO: 1424 - DNA, 18 bp, Vaccinia Virus
aaaggacaaggacatgag

SEQ ID NO: 1425 - DNA, 20 bp, Vaccinia Virus
tgcgtgttttccaccaaaga

SEQ ID NO: 1426 - DNA, 19 bp, Vaccinia Virus
ttgttccccctctctcttt

SEQ ID NO: 1427 - DNA, 19 bp, Vaccinia Virus
cttacagaagagtctctaa

SEQ ID NO: 1428 - DNA, 19 bp, Vaccinia Virus
aaaagtcaaggcatcattt

SEQ ID NO: 1429 - DNA, 21 bp, Vaccinia Virus
gtatgttgaatgtggtcccag

SEQ ID NO: 1430 - DNA, 22 bp, Vaccinia Virus
tggtaatattctatgcaactat

SEQ ID NO: 1431 - DNA, 20 bp, Vaccinia Virus
aaaatacagcttcttcctga

SEQ ID NO: 1432 - DNA, 19 bp, Vaccinia Virus
agtgtttatttcagttttc

SEQ ID NO: 1433 - DNA, 17 bp, Vaccinia Virus
ccattgcagattcgagt

SEQ ID NO: 1434 - DNA, 20 bp, Vaccinia Virus
gaagtgtcaaaatatgagaa

SEQ ID NO: 1435 - DNA, 21 bp, Vaccinia Virus
gatacatcactgaaatttgga

SEQ ID NO: 1436 - DNA, 18 bp, Vaccinia Virus
catggagatgaaatgcct

SEQ ID NO: 1437 - DNA, 19 bp, Vaccinia Virus
aacttcactctacactata

SEQ ID NO: 1438 - DNA, 19 bp, Vaccinia Virus
tagaggtaagactttaata

SEQ ID NO: 1439 - DNA, 24 bp, Vaccinia Virus
gttataaacattcttatgtgtaat

SEQ ID NO: 1440 - DNA, 23 bp, Vaccinia Virus
gccagggggcatctccaaaggaa

SEQ ID NO: 1441 - DNA, 23 bp, Vaccinia Virus
gacgtgaccactggacagttatt

SEQ ID NO: 1442 - DNA, 18 bp, Vaccinia Virus
aggaagatattttcagat

SEQ ID NO: 1443 - DNA, 23 bp, Vaccinia Virus
agaattgggttttattaatatta

SEQ ID NO: 1444 - DNA, 18 bp, Vaccinia Virus
tgattttcataccaaaga

SEQ ID NO: 1445 - DNA, 20 bp, Vaccinia Virus
aagtggataaacagaacatt

SEQ ID NO: 1446 - DNA, 24 bp, Vaccinia Virus
aactaaatttctcaactgttatga

SEQ ID NO: 1447 - DNA, 20 bp, Vaccinia Virus
ctaacaggaaacacttctca

SEQ ID NO: 1448 - DNA, 18 bp, Vaccinia Virus
caggctttgttggtaaaa

SEQ ID NO: 1449 - DNA, 24 bp, Vaccinia Virus
tgaaaaaggaagttggttatgcca

SEQ ID NO: 1450 - DNA, 19 bp, Vaccinia Virus
tgtattctgtaacagatta

SEQ ID NO: 1451 - DNA, 23 bp, Vaccinia Virus
ctgtcaaaatatacaccacttat

SEQ ID NO: 1452 - DNA, 20 bp, Vaccinia Virus
tactgcatgcatcacttctg

SEQ ID NO: 1453 - DNA, 20 bp, Vaccinia Virus
aggactttcataccgacaac

SEQ ID NO: 1454 - DNA, 19 bp, Vaccinia Virus
tggagaggaagaaacgcta

SEQ ID NO: 1455 - DNA, 18 bp, Vaccinia Virus
agtactaaaattaatgca

SEQ ID NO: 1456 - DNA, 18 bp, Vaccinia Virus
tattacactgtatttgta

SEQ ID NO: 1457 - DNA, 18 bp, Vaccinia Virus
tattacactgtatttgta

SEQ ID NO: 1458 - DNA, 18 bp, Vaccinia Virus
tattacactgtatttgta

SEQ ID NO: 1459 - DNA, 22 bp, Vaccinia Virus
aaataatttttaaggtgtatca

SEQ ID NO: 1460 - DNA, 22 bp, Vaccinia Virus
gatctaatctgatcatttaata

SEQ ID NO: 1461 - DNA, 19 bp, Vaccinia Virus
tatctatatctgtctatca

SEQ ID NO: 1462 - DNA, 18 bp, Vaccinia Virus
attggctgacagccaatt

SEQ ID NO: 1463 - DNA, 17 bp, Vaccinia Virus
tatttgtgttgtccatt

SEQ ID NO: 1464 - DNA, 18 bp, Vaccinia Virus
atgaccctgaaatgactg

SEQ ID NO: 1465 - DNA, 20 bp, Vaccinia Virus
gagattgggaacaaaaatat

SEQ ID NO: 1466 - DNA, 20 bp, Vaccinia Virus
aataaacttggtacgtattt

SEQ ID NO: 1467 - DNA, 17 bp, Vaccinia Virus
acagcattacaaaatcc

SEQ ID NO: 1468 - DNA, 19 bp, Vaccinia Virus
tattgaaaggagctaatgc

SEQ ID NO: 1469 - DNA, 18 bp, Vaccinia Virus
gagtattctttatattca

SEQ ID NO: 1470 - DNA, 20 bp, Vaccinia Virus
catgcacaccctctctgata

SEQ ID NO: 1471 - DNA, 22 bp, Vaccinia Virus
tatttcctttctctttctctct

SEQ ID NO: 1472 - DNA, 18 bp, Vaccinia Virus
ctattgagtagtattcta

SEQ ID NO: 1473 - DNA, 18 bp, Vaccinia Virus
gtcccaaaaaactgtagt

SEQ ID NO: 1474 - DNA, 17 bp, Vaccinia Virus
acctgatgtattgctct

SEQ ID NO: 1475 - DNA, 17 bp, Vaccinia Virus
gtttcttgaaagactta

SEQ ID NO: 1476 - DNA, 21 bp, Vaccinia Virus
tggaattcatactctgtggaa

SEQ ID NO: 1477 - DNA, 18 bp, Vaccinia Virus
tctgccaataaccacaaa

SEQ ID NO: 1478 - DNA, 19 bp, Vaccinia Virus
ggaaaagtgttgcctgcca

SEQ ID NO: 1479 - DNA, 18 bp, Vaccinia Virus
gtacagttaacttataga

SEQ ID NO: 1480 - DNA, 17 bp, Vaccinia Virus
cgttgaagcacaactaa

SEQ ID NO: 1481 - DNA, 17 bp, Vaccinia Virus
gaagagccattacatgc

SEQ ID NO: 1482 - DNA, 18 bp, Vaccinia Virus
gtgacggagtagaagctt

SEQ ID NO: 1483 - DNA, 20 bp, Vaccinia Virus
tgacagtggtagaataaagg

SEQ ID NO: 1484 - DNA, 17 bp, Vaccinia Virus
ctcaccccatcaccttg

SEQ ID NO: 1485 - DNA, 19 bp, Vaccinia Virus
acagcttagaagtgctata

SEQ ID NO: 1486 - DNA, 19 bp, Vaccinia Virus
aagtaaaatgcaaagatgt

SEQ ID NO: 1487 - DNA, 17 bp, Vaccinia Virus
tagaagtgaagacctta

SEQ ID NO: 1488 - DNA, 23 bp, Vaccinia Virus
tattcttattttcccctctcttt

SEQ ID NO: 1489 - DNA, 19 bp, Vaccinia Virus
agaaagaatacttttttat

SEQ ID NO: 1490 - DNA, 20 bp, Vaccinia Virus
agaggaaactttcacatgaa

SEQ ID NO: 1491 - DNA, 17 bp, Vaccinia Virus
atgaccctgagatcgtg

SEQ ID NO: 1492 - DNA, 21 bp, Vaccinia Virus
taatagtcccatatctgtaat

SEQ ID NO: 1493 - DNA, 20 bp, Vaccinia Virus
cccgtctacccctccagtca

SEQ ID NO: 1494 - DNA, 18 bp, Vaccinia Virus
ccaagaaaaacagtctca

SEQ ID NO: 1495 - DNA, 17 bp, Vaccinia Virus
tttattctctttcttct

SEQ ID NO: 1496 - DNA, 23 bp, Vaccinia Virus
taattccaagaagtttttatagt

SEQ ID NO: 1497 - DNA, 18 bp, Vaccinia Virus
ttaatatgagacatactg

SEQ ID NO: 1498 - DNA, 20 bp, Vaccinia Virus
ccattacaacagctccagga

SEQ ID NO: 1499 - DNA, 20 bp, Vaccinia Virus
ttcccctctaccagcctcca

SEQ ID NO: 1500 - DNA, 19 bp, Vaccinia Virus
gaaatatctacaggtatat

SEQ ID NO: 1501 - DNA, 18 bp, Vaccinia Virus
taggaactaaactatgcc

SEQ ID NO: 1502 - DNA, 18 bp, Vaccinia Virus
agtgtgacttttcccaca

SEQ ID NO: 1503 - DNA, 17 bp, Vaccinia Virus
aagatcatcgcaccccc

SEQ ID NO: 1504 - DNA, 20 bp, Vaccinia Virus
tagtcgatggaagactttaa

SEQ ID NO: 1505 - DNA, 22 bp, Vaccinia Virus
aaaattcagttcctccattaca

SEQ ID NO: 1506 - DNA, 23 bp, Vaccinia Virus
cagtgtgcaattagtcattgaca

SEQ ID NO: 1507 - DNA, 18 bp, Vaccinia Virus
tgggttgttgcggacatc

SEQ ID NO: 1508 - DNA, 16 bp, Vaccinia Virus
gtacaataacaactca

SEQ ID NO: 1509 - DNA, 20 bp, Vaccinia Virus
aatgacgtcagaatcatttg

SEQ ID NO: 1510 - DNA, 18 bp, Vaccinia Virus
agaaagagaagactttaa

SEQ ID NO: 1511 - DNA, 16 bp, Vaccinia Virus
tcccctctactacccc

SEQ ID NO: 1512 - DNA, 22 bp, Vaccinia Virus
cgtcatattctcaacagtttct

SEQ ID NO: 1513 - DNA, 17 bp, Vaccinia Virus
atctcaatttacactag

SEQ ID NO: 1514 - DNA, 27 bp, Vaccinia Virus
tccaaagttaattgtaaacatcatcag

SEQ ID NO: 1515 - DNA, 20 bp, Vaccinia Virus
gaaataaaattaaaggtata

SEQ ID NO: 1516 - DNA, 21 bp, Vaccinia Virus
acaaatgggtattcttttcat

SEQ ID NO: 1517 - DNA, 23 bp, Vaccinia Virus
gaaaagataattacttacatgaa

SEQ ID NO: 1518 - DNA, 20 bp, Vaccinia Virus
agaaaggtaaatctttttac

SEQ ID NO: 1519 - DNA, 17 bp, Vaccinia Virus
tctactaaaactacaaa

SEQ ID NO: 1520 - DNA, 20 bp, Vaccinia Virus
actgttattactgttacctg

SEQ ID NO: 1521 - DNA, 22 bp, Vaccinia Virus
ctcaacagtaattccactccca

SEQ ID NO: 1522 - DNA, 19 bp, Vaccinia Virus
tgaagtatgtttgtattta

SEQ ID NO: 1523 - DNA, 20 bp, Vaccinia Virus
tattctatcctctcctcttc

SEQ ID NO: 1524 - DNA, 21 bp, Vaccinia Virus
cagatgtggtcacctcagtcc

SEQ ID NO: 1525 - DNA, 23 bp, Vaccinia Virus
ccactatagcaagaaataaaggc

SEQ ID NO: 1526 - DNA, 25 bp, Vaccinia Virus
aaaattgtatattttttccatctca

SEQ ID NO: 1527 - DNA, 19 bp, Vaccinia Virus
actagaatctcttaagtat

SEQ ID NO: 1528 - DNA, 19 bp, Vaccinia Virus
tcttttaaaatacatttta

SEQ ID NO: 1529 - DNA, 17 bp, Vaccinia Virus
agaaattaagactttaa

SEQ ID NO: 1530 - DNA, 21 bp, Vaccinia Virus
tggtacagtatagtaccatta

SEQ ID NO: 1531 - DNA, 17 bp, Vaccinia Virus
ctgaaaaagccagaggc

SEQ ID NO: 1532 - DNA, 23 bp, Vaccinia Virus
tatctctgttttgggagacaggt

SEQ ID NO: 1533 - DNA, 21 bp, Vaccinia Virus
aacaaaccacaaacggatgtg

SEQ ID NO: 1534 - DNA, 19 bp, Vaccinia Virus
ttcttaaacaaaccacaaa

SEQ ID NO: 1535 - DNA, 18 bp, Vaccinia Virus
gatctcaaaacagtgcta

SEQ ID NO: 1536 - DNA, 20 bp, Vaccinia Virus
ttccctgcaatgggtgcaca

SEQ ID NO: 1537 - DNA, 21 bp, Vaccinia Virus
tattttcacaatcctctcttc

SEQ ID NO: 1538 - DNA, 24 bp, Vaccinia Virus
gacactgtttacgtccctcccact

SEQ ID NO: 1539 - DNA, 18 bp, Vaccinia Virus
tccccccccatcacctta

SEQ ID NO: 1540 - DNA, 18 bp, Vaccinia Virus
agtcacagggaagtgctg

SEQ ID NO: 1541 - DNA, 20 bp, Vaccinia Virus
ccaccgggacactccccctg

SEQ ID NO: 1542 - DNA, 22 bp, Vaccinia Virus
acttttaaggtaactgggatga

SEQ ID NO: 1543 - DNA, 22 bp, Vaccinia Virus
aattgtgatgtcctagtcctac

SEQ ID NO: 1544 - DNA, 22 bp, Vaccinia Virus
cagttgggcctaatcctgcctc

SEQ ID NO: 1545 - DNA, 21 bp, Vaccinia Virus
tgatgtcctagtcctaccact

SEQ ID NO: 1546 - DNA, 17 bp, Vaccinia Virus
aagggtagagataaact

SEQ ID NO: 1547 - DNA, 21 bp, Vaccinia Virus
aggctgccataacaaaatacc

SEQ ID NO: 1548 - DNA, 17 bp, Vaccinia Virus
gaaatgacattcacatg

SEQ ID NO: 1549 - DNA, 17 bp, Vaccinia Virus
gaaatgacattcacatg

SEQ ID NO: 1550 - DNA, 17 bp, Vaccinia Virus
gaaatgacattcacatg

SEQ ID NO: 1551 - DNA, 17 bp, Vaccinia Virus
gaaatgacattcacatg

SEQ ID NO: 1552 - DNA, 17 bp, Vaccinia Virus
gaaatgacattcacatg

SEQ ID NO: 1553 - DNA, 18 bp, Vaccinia Virus
tctatttcataccacaaa

SEQ ID NO: 1554 - DNA, 20 bp, Vaccinia Virus
tcttgtaatagttaaacctc

SEQ ID NO: 1555 - DNA, 19 bp, Vaccinia Virus
atggacttcttcatctgta

SEQ ID NO: 1556 - DNA, 19 bp, Vaccinia Virus
gccaaagacttagaagcta

SEQ ID NO: 1557 - DNA, 21 bp, Vaccinia Virus
agaacatcactgaaaatgcct

SEQ ID NO: 1558 - DNA, 18 bp, Vaccinia Virus
atgttgatttttaaatta

SEQ ID NO: 1559 - DNA, 20 bp, Vaccinia Virus
cagtatcaataaatcacttc

SEQ ID NO: 1560 - DNA, 19 bp, Vaccinia Virus
cggcattattttattccca

SEQ ID NO: 1561 - DNA, 18 bp, Vaccinia Virus
ggaaaaggaagaaagcca

SEQ ID NO: 1562 - DNA, 19 bp, Vaccinia Virus
atgttattccccattatca

SEQ ID NO: 1563 - DNA, 18 bp, Vaccinia Virus
tctagtggatgagaatca

SEQ ID NO: 1564 - DNA, 21 bp, Vaccinia Virus
tgtgactttgccccaaatttg

SEQ ID NO: 1565 - DNA, 21 bp, Vaccinia Virus
taaaaaaaggagcaaaagtat

SEQ ID NO: 1566 - DNA, 25 bp, Vaccinia Virus
agagaaagtttgtaaaattccttac

SEQ ID NO: 1567 - DNA, 18 bp, Vaccinia Virus
catgggaagtgaaagctg

SEQ ID NO: 1568 - DNA, 18 bp, Vaccinia Virus
gccaatgggaacttctca

SEQ ID NO: 1569 - DNA, 19 bp, Vaccinia Virus
aatctataaaacaaaacaa

SEQ ID NO: 1570 - DNA, 19 bp, Vaccinia Virus
aaaaccttgcattccatca

SEQ ID NO: 1571 - DNA, 20 bp, Vaccinia Virus
tttgccaaaagcagtccttc

SEQ ID NO: 1572 - DNA, 21 bp, Vaccinia Virus
agttggacacacccctcctcg

SEQ ID NO: 1573 - DNA, 23 bp, Vaccinia Virus
atggagaaaaagcagggatgcta

SEQ ID NO: 1574 - DNA, 20 bp, Vaccinia Virus
ggaaactgtaacaggacatt

SEQ ID NO: 1575 - DNA, 19 bp, Vaccinia Virus
aaaggcagagaggccagga

SEQ ID NO: 1576 - DNA, 25 bp, Vaccinia Virus
acacttcagccgcagccaaatagca

SEQ ID NO: 1577 - DNA, 19 bp, Vaccinia Virus
ttctgaataaatttacagt

SEQ ID NO: 1578 - DNA, 18 bp, Vaccinia Virus
agaaaactagtgatacca

SEQ ID NO: 1579 - DNA, 22 bp, Vaccinia Virus
attcttatgtttttctcttttc

SEQ ID NO: 1580 - DNA, 18 bp, Vaccinia Virus
agatgtagaactttaata

SEQ ID NO: 1581 - DNA, 24 bp, Vaccinia Virus
atgacagtatctgcagatactata

SEQ ID NO: 1582 - DNA, 21 bp, Vaccinia Virus
attatgcattactccacatcc

SEQ ID NO: 1583 - DNA, 19 bp, Vaccinia Virus
ggaaacaaacttcaggtca

SEQ ID NO: 1584 - DNA, 23 bp, Vaccinia Virus
aaaatggtattattaataccata

SEQ ID NO: 1585 - DNA, 18 bp, Vaccinia Virus
aagaaatgtctgtacaaa

SEQ ID NO: 1586 - DNA, 21 bp, Vaccinia Virus
actgatatattataaactaac

SEQ ID NO: 1587 - DNA, 20 bp, Vaccinia Virus
tagtcacgcggcacgcgccg

SEQ ID NO: 1588 - DNA, 18 bp, Vaccinia Virus
atgatgtatattatcgat

SEQ ID NO: 1589 - DNA, 18 bp, Vaccinia Virus
tctgcattgaactagaaa

SEQ ID NO: 1590 - DNA, 20 bp, Vaccinia Virus
ttctatccggtagtcacaaa

SEQ ID NO: 1591 - DNA, 17 bp, Vaccinia Virus
aaacaaatgagatggac

SEQ ID NO: 1592 - DNA, 20 bp, Vaccinia Virus
ccattatacagtctttctca

SEQ ID NO: 1593 - DNA, 20 bp, Vaccinia Virus
caaaagaaaaaaaattctcc

SEQ ID NO: 1594 - DNA, 22 bp, Vaccinia Virus
acaaattcgtaagtatcctcta

SEQ ID NO: 1595 - DNA, 21 bp, Vaccinia Virus
aatctacagacattaaacaat

SEQ ID NO: 1596 - DNA, 23 bp, Vaccinia Virus
aagaaagttttatttgtatttta

SEQ ID NO: 1597 - DNA, 21 bp, Vaccinia Virus
ttcccctaagttctattccat

SEQ ID NO: 1598 - DNA, 18 bp, Vaccinia Virus
gctaacaaaagcttctca

SEQ ID NO: 1599 - DNA, 21 bp, Vaccinia Virus
aatgcctggcaaattacctga

SEQ ID NO: 1600 - DNA, 21 bp, Vaccinia Virus
atagatgatgaaaagctgtta

SEQ ID NO: 1601 - DNA, 21 bp, Vaccinia Virus
agaaagatttaaagtatttta

SEQ ID NO: 1602 - DNA, 20 bp, Vaccinia Virus
ggtgggatcaacatacattg

SEQ ID NO: 1603 - DNA, 19 bp, Vaccinia Virus
caaagtgatggaaccctca

SEQ ID NO: 1604 - DNA, 21 bp, Vaccinia Virus
aggactttcccgtccacacac

SEQ ID NO: 1605 - DNA, 18 bp, Vaccinia Virus
atagatgaattagtaagc

SEQ ID NO: 1606 - DNA, 16 bp, Vaccinia Virus
gaattggtctgtggaa

SEQ ID NO: 1607 - DNA, 19 bp, Vaccinia Virus
tacctcaagtatcaattca

SEQ ID NO: 1608 - DNA, 23 bp, Vaccinia Virus
gaaatataattcttaatatcata

SEQ ID NO: 1609 - DNA, 19 bp, Vaccinia Virus
gacagcgccaataacaata

SEQ ID NO: 1610 - DNA, 24 bp, Vaccinia Virus
acttctatatagagatagacttac

SEQ ID NO: 1611 - DNA, 20 bp, Vaccinia Virus
atgaatgaaaaatccatcca

SEQ ID NO: 1612 - DNA, 19 bp, Vaccinia Virus
tgcccatatgtccatttat

SEQ ID NO: 1613 - DNA, 19 bp, Vaccinia Virus
atacagatagaaacataga

SEQ ID NO: 1614 - DNA, 18 bp, Vaccinia Virus
gctaatgatgacatctca

SEQ ID NO: 1615 - DNA, 17 bp, Vaccinia Virus
ggatcatttgtattttg

SEQ ID NO: 1616 - DNA, 21 bp, Vaccinia Virus
aatagtggtcagaaaaatact

SEQ ID NO: 1617 - DNA, 23 bp, Vaccinia Virus
ttgtacaatattttgtacaaaga

SEQ ID NO: 1618 - DNA, 17 bp, Vaccinia Virus
ttctactcaactacaaa

SEQ ID NO: 1619 - DNA, 21 bp, Vaccinia Virus
aataatgtcattctcaattaa

SEQ ID NO: 1620 - DNA, 19 bp, Vaccinia Virus
gctgcgtattatttctata

SEQ ID NO: 1621 - DNA, 22 bp, Vaccinia Virus
agcactgtggttgagtaacatc

SEQ ID NO: 1622 - DNA, 18 bp, Vaccinia Virus
tatgttgaattgatctag

SEQ ID NO: 1623 - DNA, 18 bp, Vaccinia Virus
atgtcagtaggagactta

SEQ ID NO: 1624 - DNA, 18 bp, Vaccinia Virus
gtttacatccttcccact

SEQ ID NO: 1625 - DNA, 16 bp, Vaccinia Virus
ttctcatagaacacca

SEQ ID NO: 1626 - DNA, 17 bp, Vaccinia Virus
tctgctgtcactcaagg

SEQ ID NO: 1627 - DNA, 18 bp, Vaccinia Virus
ttttattccctttcctct

SEQ ID NO: 1628 - DNA, 18 bp, Vaccinia Virus
ctctggcaaagtcttcaa

SEQ ID NO: 1629 - DNA, 19 bp, Vaccinia Virus
ccactccggagatccgggt

SEQ ID NO: 1630 - DNA, 23 bp, Vaccinia Virus
aatacaggaaatagataaacatg

SEQ ID NO: 1631 - DNA, 20 bp, Vaccinia Virus
ttctggcctccagaactaga

SEQ ID NO: 1632 - DNA, 16 bp, Vaccinia Virus
acgatggggatacatt

SEQ ID NO: 1633 - DNA, 16 bp, Vaccinia Virus
tgatgccaactcagac

SEQ ID NO: 1634 - DNA, 21 bp, Vaccinia Virus
ggcccccagtgctctgtggga

SEQ ID NO: 1635 - DNA, 16 bp, Vaccinia Virus
atttctggtgaattac

SEQ ID NO: 1636 - DNA, 20 bp, Vaccinia Virus
cttttaaatgaaaaagatta

SEQ ID NO: 1637 - DNA, 16 bp, Vaccinia Virus
tatgctgaagactggt

SEQ ID NO: 1638 - DNA, 17 bp, Vaccinia Virus
tcatttcaaaccacaaa

SEQ ID NO: 1639 - DNA, 17 bp, Vaccinia Virus
tattcctctttcttttc

SEQ ID NO: 1640 - DNA, 19 bp, Vaccinia Virus
tttccagaagggtctccaa

SEQ ID NO: 1641 - DNA, 19 bp, Vaccinia Virus
ggactcttatgtcactgca

SEQ ID NO: 1642 - DNA, 16 bp, Vaccinia Virus
atgttacaactacttt

SEQ ID NO: 1643 - DNA, 21 bp, Vaccinia Virus
aataaacttgctgatgcattt

SEQ ID NO: 1644 - DNA, 24 bp, Vaccinia Virus
ttaaatatgcatctggcccaggaa

SEQ ID NO: 1645 - DNA, 24 bp, Vaccinia Virus
ttaaatatgcatctggcccaggaa

SEQ ID NO: 1646 - DNA, 24 bp, Vaccinia Virus
ttaaatatgcatctggcccaggaa

SEQ ID NO: 1647 - DNA, 18 bp, Vaccinia Virus
ccgcagcgcgcggaggaa

SEQ ID NO: 1648 - DNA, 17 bp, Vaccinia Virus
tcttggaagaatctcaa

SEQ ID NO: 1649 - DNA, 19 bp, Vaccinia Virus
ccttaaaacacacatggga

SEQ ID NO: 1650 - DNA, 18 bp, Vaccinia Virus
ttttgttcgcctctcttc

SEQ ID NO: 1651 - DNA, 21 bp, Vaccinia Virus
tattttccaagtttctctctc

SEQ ID NO: 1652 - DNA, 21 bp, Vaccinia Virus
agaaagatttaaagtatttta

SEQ ID NO: 1653 - DNA, 16 bp, Vaccinia Virus
cgaaaattaaacctct

SEQ ID NO: 1654 - DNA, 18 bp, Vaccinia Virus
aaaatacataggaaaaga

SEQ ID NO: 1655 - DNA, 20 bp, Vaccinia Virus
aaaatgaaaccctgtagcca

SEQ ID NO: 1656 - DNA, 20 bp, Vaccinia Virus
aaaacaattcttcattcaga

SEQ ID NO: 1657 - DNA, 17 bp, Vaccinia Virus
ttctggtataccacaaa

SEQ ID NO: 1658 - DNA, 20 bp, Vaccinia Virus
gaggcacttaatacatgtat

SEQ ID NO: 1659 - DNA, 19 bp, Vaccinia Virus
aagtattaaaaccaaggaa

SEQ ID NO: 1660 - DNA, 19 bp, Vaccinia Virus
acaaataaggaaaacagct

SEQ ID NO: 1661 - DNA, 22 bp, Vaccinia Virus
aaaaggcagaaacatacctttg

SEQ ID NO: 1662 - DNA, 16 bp, Vaccinia Virus
tctctggagtcttcaa

SEQ ID NO: 1663 - DNA, 18 bp, Vaccinia Virus
ttcacaagccattaggga

SEQ ID NO: 1664 - DNA, 18 bp, Vaccinia Virus
gatcaaaatcatttgata

SEQ ID NO: 1665 - DNA, 22 bp, Vaccinia Virus
agctgcaaaaacgagctcttca

SEQ ID NO: 1666 - DNA, 21 bp, Vaccinia Virus
attgaaaggggaaatgtgtca

SEQ ID NO: 1667 - DNA, 18 bp, Vaccinia Virus
gcaaaaacgagctcttca

SEQ ID NO: 1668 - DNA, 19 bp, Vaccinia Virus
atcagttcgcctccattcc

SEQ ID NO: 1669 - DNA, 17 bp, Vaccinia Virus
ggccaaagccagagact

SEQ ID NO: 1670 - DNA, 21 bp, Vaccinia Virus
atatttttataaggctttttt

SEQ ID NO: 1671 - DNA, 23 bp, Vaccinia Virus
ggtggcggggttttgcagagctc

SEQ ID NO: 1672 - DNA, 20 bp, Vaccinia Virus
gattgtacaaatacaaggaa

SEQ ID NO: 1673 - DNA, 20 bp, Vaccinia Virus
acaaattgtaaagaatatgt

SEQ ID NO: 1674 - DNA, 19 bp, Vaccinia Virus
tgactttccttaatgttta

SEQ ID NO: 1675 - DNA, 18 bp, Vaccinia Virus
tatccctgggttacacta

SEQ ID NO: 1676 - DNA, 19 bp, Vaccinia Virus
cagctccgacgccctcccg

SEQ ID NO: 1677 - DNA, 19 bp, Vaccinia Virus
tagtagtatgtaactatta

SEQ ID NO: 1678 - DNA, 18 bp, Vaccinia Virus
gatgacagccccacctcc

SEQ ID NO: 1679 - DNA, 22 bp, Vaccinia Virus
ataccagaaacatctacttggg

SEQ ID NO: 1680 - DNA, 16 bp, Vaccinia Virus
gaagtcattgtattca

SEQ ID NO: 1681 - DNA, 17 bp, Vaccinia Virus
tgtgaggcccaattcca

SEQ ID NO: 1682 - DNA, 17 bp, Vaccinia Virus
aggcagaaggatcactt

SEQ ID NO: 1683 - DNA, 18 bp, Vaccinia Virus
tgatagtgtctgcacaac

SEQ ID NO: 1684 - DNA, 17 bp, Vaccinia Virus
caaatgtaaggccatga

SEQ ID NO: 1685 - DNA, 18 bp, Vaccinia Virus
ttggaaattaaaggtgga

SEQ ID NO: 1686 - DNA, 18 bp, Vaccinia Virus
gccaacgaggaacacagc

SEQ ID NO: 1687 - DNA, 17 bp, Vaccinia Virus
actgaaaatagaattgg

SEQ ID NO: 1688 - DNA, 21 bp, Vaccinia Virus
agcatttcataaatgtttagt

SEQ ID NO: 1689 - DNA, 23 bp, Vaccinia Virus
ggtggcgggggtggtgctggctc

SEQ ID NO: 1690 - DNA, 18 bp, Vaccinia Virus
aagctgtccgttgtattc

SEQ ID NO: 1691 - DNA, 18 bp, Vaccinia Virus
gatatgtatgaatgcaaa

SEQ ID NO: 1692 - DNA, 20 bp, Vaccinia Virus
gaaaagagttttaaaaaaga

SEQ ID NO: 1693 - DNA, 19 bp, Vaccinia Virus
ccgccaattttttacaaat

SEQ ID NO: 1694 - DNA, 18 bp, Vaccinia Virus
tgatggaagtggaagatt

SEQ ID NO: 1695 - DNA, 18 bp, Vaccinia Virus
ttctggaaaagtcctcaa

SEQ ID NO: 1696 - DNA, 18 bp, Vaccinia Virus
ttcatatggacccagaga

SEQ ID NO: 1697 - DNA, 20 bp, Vaccinia Virus
tgtaacttcctgtgaattta

SEQ ID NO: 1698 - DNA, 18 bp, Vaccinia Virus
tctatctgcacacacaaa

SEQ ID NO: 1699 - DNA, 21 bp, Vaccinia Virus
cggtgactatatgagaatgga

SEQ ID NO: 1700 - DNA, 18 bp, Vaccinia Virus
ctctggcaaagtcttcaa

SEQ ID NO: 1701 - DNA, 18 bp, Vaccinia Virus
gaaacgaaaaagttaagc

SEQ ID NO: 1702 - DNA, 21 bp, Vaccinia Virus
agaatgataaattatcaatat

SEQ ID NO: 1703 - DNA, 18 bp, Vaccinia Virus
tgactaaggaactgcagc

SEQ ID NO: 1704 - DNA, 20 bp, Vaccinia Virus
ggaaactaaactctgtggaa

SEQ ID NO: 1705 - DNA, 20 bp, Vaccinia Virus
ttctccaggctcaggtgcca

SEQ ID NO: 1706 - DNA, 26 bp, Vaccinia Virus
cctcagaatgatgaaaaatatgaatg

SEQ ID NO: 1707 - DNA, 24 bp, Vaccinia Virus
gaaaagaattctgttgaaatcagt

SEQ ID NO: 1708 - DNA, 22 bp, Vaccinia Virus
acttccagtttttggattggga

SEQ ID NO: 1709 - DNA, 18 bp, Vaccinia Virus
agtcacagacggatttgc

SEQ ID NO: 1710 - DNA, 15 bp, Vaccinia Virus
cccctttctactcca

SEQ ID NO: 1711 - DNA, 20 bp, Vaccinia Virus
gaaaggtgttcttacatgaa

SEQ ID NO: 1712 - DNA, 20 bp, Vaccinia Virus
gaaaggtgttcttacatgaa

SEQ ID NO: 1713 - DNA, 20 bp, Vaccinia Virus
gaaaggtgttcttacatgaa

SEQ ID NO: 1714 - DNA, 18 bp, Vaccinia Virus
ctcatgggcactcacaga

SEQ ID NO: 1715 - DNA, 24 bp, Vaccinia Virus
tgaaaaaggaaacagtgcacacca

SEQ ID NO: 1716 - DNA, 23 bp, Vaccinia Virus
ccaagtcacagatagacattcca

SEQ ID NO: 1717 - DNA, 24 bp, Vaccinia Virus
tggaaaaattttaatttgtagcca

SEQ ID NO: 1718 - DNA, 22 bp, Vaccinia Virus
tggtaatattctatgcaactat

SEQ ID NO: 1719 - DNA, 24 bp, Vaccinia Virus
atgtttcatgcatccatacttctg

SEQ ID NO: 1720 - DNA, 22 bp, Vaccinia Virus
aaagttcaaaagtagaaatacc

SEQ ID NO: 1721 - DNA, 19 bp, Vaccinia Virus
agtgagctgagaccatgcc

SEQ ID NO: 1722 - DNA, 18 bp, Vaccinia Virus
ccaaataggcatcatcaa

SEQ ID NO: 1723 - DNA, 24 bp, Vaccinia Virus
cagctcccccttcacccctccttg

SEQ ID NO: 1724 - DNA, 21 bp, Vaccinia Virus
agactggcttaagccaggagc

SEQ ID NO: 1725 - DNA, 20 bp, Vaccinia Virus
ttggaaatatgttcctggaa

SEQ ID NO: 1726 - DNA, 20 bp, Vaccinia Virus
taagagaatgttgtgtattt

SEQ ID NO: 1727 - DNA, 22 bp, Vaccinia Virus
cagttgagcctcatggctctcc

SEQ ID NO: 1728 - DNA, 16 bp, Vaccinia Virus
agccacaggagatgtc

SEQ ID NO: 1729 - DNA, 23 bp, Vaccinia Virus
agcattattgaaataaatgttta

SEQ ID NO: 1730 - DNA, 21 bp, Vaccinia Virus
ctgaaataatcgaacaggaaa

SEQ ID NO: 1731 - DNA, 15 bp, Vaccinia Virus
agaaaaagactttaa

SEQ ID NO: 1732 - DNA, 23 bp, Vaccinia Virus
tctgtgataagcagaactagaaa

SEQ ID NO: 1733 - DNA, 19 bp, Vaccinia Virus
atgttctgtcatgaatact

SEQ ID NO: 1734 - DNA, 21 bp, Vaccinia Virus
tacagtgatagcaactttcca

SEQ ID NO: 1735 - DNA, 21 bp, Vaccinia Virus
tgggataactactttaaagaa

SEQ ID NO: 1736 - DNA, 22 bp, Vaccinia Virus
caatactctcaattattaacca

SEQ ID NO: 1737 - DNA, 18 bp, Vaccinia Virus
accatatcaatccatata

SEQ ID NO: 1738 - DNA, 19 bp, Vaccinia Virus
atgttgtaattgtcatatc

SEQ ID NO: 1739 - DNA, 21 bp, Vaccinia Virus
atggtgggtgatttcagatat

SEQ ID NO: 1740 - DNA, 22 bp, Vaccinia Virus
acatttgttctcttggatctca

SEQ ID NO: 1741 - DNA, 21 bp, Vaccinia Virus
cctgccctgcttccccaccca

SEQ ID NO: 1742 - DNA, 20 bp, Vaccinia Virus
atgaataacatttcagatac

SEQ ID NO: 1743 - DNA, 19 bp, Vaccinia Virus
ttggaaatctgcctgcaga

SEQ ID NO: 1744 - DNA, 17 bp, Vaccinia Virus
cacctgctggtaaaaga

SEQ ID NO: 1745 - DNA, 24 bp, Vaccinia Virus
tactgccttcataagatcaagtca

SEQ ID NO: 1746 - DNA, 20 bp, Vaccinia Virus
aaaggacaactgtagatgaa

SEQ ID NO: 1747 - DNA, 18 bp, Vaccinia Virus
tattcctgtctcctcttt

SEQ ID NO: 1748 - DNA, 24 bp, Vaccinia Virus
acattaataaatttattgattcca

SEQ ID NO: 1749 - DNA, 19 bp, Vaccinia Virus
taaagctggttaaggtggt

SEQ ID NO: 1750 - DNA, 18 bp, Vaccinia Virus
gctttgaaaaacttttca

SEQ ID NO: 1751 - DNA, 21 bp, Vaccinia Virus
aagtttacatgtactaactta

SEQ ID NO: 1752 - DNA, 20 bp, Vaccinia Virus
gcctattcaggatattaact

SEQ ID NO: 1753 - DNA, 17 bp, Vaccinia Virus
atagacgaaaatcaact

SEQ ID NO: 1754 - DNA, 20 bp, Vaccinia Virus
tagaaataaacaaggcttta

SEQ ID NO: 1755 - DNA, 23 bp, Vaccinia Virus
tgacggctttttgacaagactta

SEQ ID NO: 1756 - DNA, 18 bp, Vaccinia Virus
ccatctggaggaaataaa

SEQ ID NO: 1757 - DNA, 21 bp, Vaccinia Virus
gctgttaccatctcagaggaa

SEQ ID NO: 1758 - DNA, 18 bp, Vaccinia Virus
aaaggtatgtgaataaat

SEQ ID NO: 1759 - DNA, 16 bp, Vaccinia Virus
aaggaatgctaggcgg

SEQ ID NO: 1760 - DNA, 17 bp, Vaccinia Virus
cagtgaggtagcatcta

SEQ ID NO: 1761 - DNA, 17 bp, Vaccinia Virus
ccaagcttggtctgtca

SEQ ID NO: 1762 - DNA, 20 bp, Vaccinia Virus
aacaggagaatcacttgatg

SEQ ID NO: 1763 - DNA, 20 bp, Vaccinia Virus
cagtcacctgatgactctcc

SEQ ID NO: 1764 - DNA, 19 bp, Vaccinia Virus
ttaaatggaccatgatact

SEQ ID NO: 1765 - DNA, 21 bp, Vaccinia Virus
ctcacagtcctactgaacctc

SEQ ID NO: 1766 - DNA, 18 bp, Vaccinia Virus
ggtgcaaggattgagctc

SEQ ID NO: 1767 - DNA, 18 bp, Vaccinia Virus
ttctaccaaaactacaaa

SEQ ID NO: 1768 - DNA, 22 bp, Vaccinia Virus
cagattgccaccccagcaccta

SEQ ID NO: 1769 - DNA, 20 bp, Vaccinia Virus
gctaatggacttgactctca

SEQ ID NO: 1770 - DNA, 18 bp, Vaccinia Virus
ctaatggacatcttctca

SEQ ID NO: 1771 - DNA, 23 bp, Vaccinia Virus
atatttttgtaaaatgtatttgt

SEQ ID NO: 1772 - DNA, 15 bp, Vaccinia Virus
ttctatctagcacaa

SEQ ID NO: 1773 - DNA, 17 bp, Vaccinia Virus
ttgtttactgatgagaa

SEQ ID NO: 1774 - DNA, 23 bp, Vaccinia Virus
gacgtttaccagtaatatcacca

SEQ ID NO: 1775 - DNA, 18 bp, Vaccinia Virus
tctgacagataccacgaa

SEQ ID NO: 1776 - DNA, 19 bp, Vaccinia Virus
agctcctgtcaccctgtca

SEQ ID NO: 1777 - DNA, 18 bp, Vaccinia Virus
ccccgtgttggtaagaga

SEQ ID NO: 1778 - DNA, 18 bp, Vaccinia Virus
atttttattctacctttc

SEQ ID NO: 1779 - DNA, 15 bp, Vaccinia Virus
ttttattctcctttc

SEQ ID NO: 1780 - DNA, 20 bp, Vaccinia Virus
aagtaataaattccaacaaa

SEQ ID NO: 1781 - DNA, 19 bp, Vaccinia Virus
gccaatgaaaatgtgcttc

SEQ ID NO: 1782 - DNA, 16 bp, Vaccinia Virus
aaagcatatccgttca

SEQ ID NO: 1783 - DNA, 25 bp, Vaccinia Virus
gatggctcttatcatcatctttata

SEQ ID NO: 1784 - DNA, 24 bp, Vaccinia Virus
atgcctataataccataatgccag

SEQ ID NO: 1785 - DNA, 21 bp, Vaccinia Virus
tgtgactttctggaccttaga

SEQ ID NO: 1786 - DNA, 18 bp, Vaccinia Virus
gtacagttttagtataga

SEQ ID NO: 1787 - DNA, 18 bp, Vaccinia Virus
taggaatttttattccca

SEQ ID NO: 1788 - DNA, 18 bp, Vaccinia Virus
aggattttagtatcctca

SEQ ID NO: 1789 - DNA, 18 bp, Vaccinia Virus
tacagtatgacaactatt

SEQ ID NO: 1790 - DNA, 21 bp, Vaccinia Virus
agggaattaaagaaagccatg

SEQ ID NO: 1791 - DNA, 22 bp, Vaccinia Virus
cagctccagccatccacccctc

SEQ ID NO: 1792 - DNA, 22 bp, Vaccinia Virus
atcaacaaacaaatcaaagcca

SEQ ID NO: 1793 - DNA, 19 bp, Vaccinia Virus
tttattcatttctctcctc

SEQ ID NO: 1794 - DNA, 17 bp, Vaccinia Virus
ccttcatccactccatg

SEQ ID NO: 1795 - DNA, 23 bp, Vaccinia Virus
ttggaaattagtgttatctggaa

SEQ ID NO: 1796 - DNA, 19 bp, Vaccinia Virus
ttttttaaaatatatttta

SEQ ID NO: 1797 - DNA, 24 bp, Vaccinia Virus
agatgtttttattttatattatta

SEQ ID NO: 1798 - DNA, 18 bp, Vaccinia Virus
atcccatctgggtcactt

SEQ ID NO: 1799 - DNA, 20 bp, Vaccinia Virus
tatttttactctccctcttc

SEQ ID NO: 1800 - DNA, 19 bp, Vaccinia Virus
tcctatttccctgccatca

SEQ ID NO: 1801 - DNA, 18 bp, Vaccinia Virus
tctcatagtatgcccata

SEQ ID NO: 1802 - DNA, 21 bp, Vaccinia Virus
gagtgctccttttgtatttta

SEQ ID NO: 1803 - DNA, 23 bp, Vaccinia Virus
gaaaggataacatttctcatgaa

SEQ ID NO: 1804 - DNA, 17 bp, Vaccinia Virus
tctgcctacactattta

SEQ ID NO: 1805 - DNA, 18 bp, Vaccinia Virus
atgtttggtcctcctctg

SEQ ID NO: 1806 - DNA, 18 bp, Vaccinia Virus
tacagccattgcaaaaca

SEQ ID NO: 1807 - DNA, 21 bp, Vaccinia Virus
gttctgctatttactctgtgg

SEQ ID NO: 1808 - DNA, 21 bp, Vaccinia Virus
agaatcaatactacaactgca

SEQ ID NO: 1809 - DNA, 16 bp, Vaccinia Virus
aatggccacctgatga

SEQ ID NO: 1810 - DNA, 18 bp, Vaccinia Virus
ctatttactgatcacaaa

SEQ ID NO: 1811 - DNA, 21 bp, Vaccinia Virus
gacaaagtctcgctctgtcac

SEQ ID NO: 1812 - DNA, 21 bp, Vaccinia Virus
aggacacatggggtacaaaga

SEQ ID NO: 1813 - DNA, 19 bp, Vaccinia Virus
ctaaatgtgagatcaagga

SEQ ID NO: 1814 - DNA, 20 bp, Vaccinia Virus
tgaagttttgattgtattta

SEQ ID NO: 1815 - DNA, 18 bp, Vaccinia Virus
tgacagcgagatgcaagc

SEQ ID NO: 1816 - DNA, 19 bp, Vaccinia Virus
agactaacatccattctga

SEQ ID NO: 1817 - DNA, 20 bp, Vaccinia Virus
taatgttcggcaaacatgaa

SEQ ID NO: 1818 - DNA, 21 bp, Vaccinia Virus
gaagcccgaaacaagacatta

SEQ ID NO: 1819 - DNA, 19 bp, Vaccinia Virus
cactacagagcactgtttg

SEQ ID NO: 1820 - DNA, 24 bp, Vaccinia Virus
atatctttgtagtagcttttttta

SEQ ID NO: 1821 - DNA, 24 bp, Vaccinia Virus
taaaatgggatttataaaaatatt

SEQ ID NO: 1822 - DNA, 18 bp, Vaccinia Virus
gcggtatttactacctag

SEQ ID NO: 1823 - DNA, 21 bp, Vaccinia Virus
cagacatggccttagtaccta

SEQ ID NO: 1824 - DNA, 18 bp, Vaccinia Virus
tgctgaaaaacactcttc

SEQ ID NO: 1825 - DNA, 17 bp, Vaccinia Virus
tcatggatcatgtccac

SEQ ID NO: 1826 - DNA, 19 bp, Vaccinia Virus
aaagaaataaatccaacaa

SEQ ID NO: 1827 - DNA, 19 bp, Vaccinia Virus
aggtggaagttgctagtgc

SEQ ID NO: 1828 - DNA, 17 bp, Vaccinia Virus
acagtaacaatttgcca

SEQ ID NO: 1829 - DNA, 20 bp, Vaccinia Virus
tatccctgttgcgcacacta

SEQ ID NO: 1830 - DNA, 15 bp, Vaccinia Virus
aagcaagacaacaac

SEQ ID NO: 1831 - DNA, 23 bp, Vaccinia Virus
tgcaagaaaaaggacttattaaa

SEQ ID NO: 1832 - DNA, 22 bp, Vaccinia Virus
acagataataaatatccagtgt

SEQ ID NO: 1833 - DNA, 20 bp, Vaccinia Virus
aagggctgcattgtatttta

SEQ ID NO: 1834 - DNA, 19 bp, Vaccinia Virus
tatgtaaatcctacttttg

SEQ ID NO: 1835 - DNA, 17 bp, Vaccinia Virus
ctatgcaaattaccaca

SEQ ID NO: 1836 - DNA, 20 bp, Vaccinia Virus
gatattaacagtcatcctag

SEQ ID NO: 1837 - DNA, 21 bp, Vaccinia Virus
ctctaagcaacaaggggagcg

SEQ ID NO: 1838 - DNA, 24 bp, Vaccinia Virus
gctgatggtcctgtccaaaggcta

SEQ ID NO: 1839 - DNA, 20 bp, Vaccinia Virus
ctgtgggcaataaatgtctg

SEQ ID NO: 1840 - DNA, 17 bp, Vaccinia Virus
cggtatgtaaatatgaa

SEQ ID NO: 1841 - DNA, 18 bp, Vaccinia Virus
acacctttgctaccagta

SEQ ID NO: 1842 - DNA, 19 bp, Vaccinia Virus
caagtattttaaaacactg

SEQ ID NO: 1843 - DNA, 19 bp, Vaccinia Virus
gaactaatgttctgtggaa

SEQ ID NO: 1844 - DNA, 18 bp, Vaccinia Virus
taatgttctgtggaacat

SEQ ID NO: 1845 - DNA, 21 bp, Vaccinia Virus
tactttgagaaacattgacta

SEQ ID NO: 1846 - DNA, 20 bp, Vaccinia Virus
agtgttttacacatactgat

SEQ ID NO: 1847 - DNA, 20 bp, Vaccinia Virus
cctgcagcagacccgagttg

SEQ ID NO: 1848 - DNA, 22 bp, Vaccinia Virus
caatatctcataagactactgc

SEQ ID NO: 1849 - DNA, 20 bp, Vaccinia Virus
gacaaaattcatttttttca

SEQ ID NO: 1850 - DNA, 19 bp, Vaccinia Virus
aaatcagtgaatggtactg

SEQ ID NO: 1851 - DNA, 23 bp, Vaccinia Virus
aatctatggcttgattaaaaata

SEQ ID NO: 1852 - DNA, 20 bp, Vaccinia Virus
aaacaaagagacaggaatta

SEQ ID NO: 1853 - DNA, 18 bp, Vaccinia Virus
caaatgctgtttatgata

SEQ ID NO: 1854 - DNA, 19 bp, Vaccinia Virus
ccattacaaaatgtaatgg

SEQ ID NO: 1855 - DNA, 19 bp, Vaccinia Virus
cagttgggccggactctcc

SEQ ID NO: 1856 - DNA, 17 bp, Vaccinia Virus
cccctcctcttactccg

SEQ ID NO: 1857 - DNA, 23 bp, Vaccinia Virus
tataataaaacatgattgcttaa

SEQ ID NO: 1858 - DNA, 19 bp, Vaccinia Virus
gtggggcagacaaaggcag

SEQ ID NO: 1859 - DNA, 19 bp, Vaccinia Virus
tgaagtattcaggttctca

SEQ ID NO: 1860 - DNA, 17 bp, Vaccinia Virus
atatgacttcttcacat

SEQ ID NO: 1861 - DNA, 19 bp, Vaccinia Virus
ctgtggacacacaaggtga

SEQ ID NO: 1862 - DNA, 20 bp, Vaccinia Virus
gaagaacagttgaaacatgc

SEQ ID NO: 1863 - DNA, 18 bp, Vaccinia Virus
ttttggctactgatgtta

SEQ ID NO: 1864 - DNA, 23 bp, Vaccinia Virus
atccactaaactggtcttcttca

SEQ ID NO: 1865 - DNA, 22 bp, Vaccinia Virus
gaaaagagtaacagaaagatag

SEQ ID NO: 1866 - DNA, 22 bp, Vaccinia Virus
gagaaagagaaggtctatgtca

SEQ ID NO: 1867 - DNA, 17 bp, Vaccinia Virus
ttggaaatagctttgtg

SEQ ID NO: 1868 - DNA, 20 bp, Vaccinia Virus
tagaagtttgaagactttaa

SEQ ID NO: 1869 - DNA, 19 bp, Vaccinia Virus
acattaagtcctacctctg

SEQ ID NO: 1870 - DNA, 22 bp, Vaccinia Virus
gacaggaagaaaaatacagtta

SEQ ID NO: 1871 - DNA, 21 bp, Vaccinia Virus
aagtggcaactgtcaaagatg

SEQ ID NO: 1872 - DNA, 22 bp, Vaccinia Virus
tgaagtaattgtgctgtattta

SEQ ID NO: 1873 - DNA, 20 bp, Vaccinia Virus
gaatattttcagatactata

SEQ ID NO: 1874 - DNA, 23 bp, Vaccinia Virus
aatatttttaaaatctcctttct

SEQ ID NO: 1875 - DNA, 15 bp, Vaccinia Virus
tgtgatggagtatac

SEQ ID NO: 1876 - DNA, 18 bp, Vaccinia Virus
aaaatgtttcctctttct

SEQ ID NO: 1877 - DNA, 17 bp, Vaccinia Virus
cctgctcaacttctcca

SEQ ID NO: 1878 - DNA, 22 bp, Vaccinia Virus
tctccacgtccaggtgtacaca

SEQ ID NO: 1879 - DNA, 18 bp, Vaccinia Virus
aggatttacatagacaat

SEQ ID NO: 1880 - DNA, 21 bp, Vaccinia Virus
aggatatgtgtgctatataaa

SEQ ID NO: 1881 - DNA, 20 bp, Vaccinia Virus
tttgccaaaaaagtccccta

SEQ ID NO: 1882 - DNA, 22 bp, Vaccinia Virus
ctgtaggacagtttatcagtca

SEQ ID NO: 1883 - DNA, 22 bp, Vaccinia Virus
gccgcagtgtcacctcagtgga

SEQ ID NO: 1884 - DNA, 19 bp, Vaccinia Virus
ttatgccatgaacatgcca

SEQ ID NO: 1885 - DNA, 21 bp, Vaccinia Virus
atacgcaaacacaccgatgca

SEQ ID NO: 1886 - DNA, 18 bp, Vaccinia Virus
gaagaagcaattacttca

SEQ ID NO: 1887 - DNA, 20 bp, Vaccinia Virus
atttattcactgatagagaa

SEQ ID NO: 1888 - DNA, 19 bp, Vaccinia Virus
gagaatcttggggatgctg

SEQ ID NO: 1889 - DNA, 19 bp, Vaccinia Virus
ctgtctccccactcagtgg

SEQ ID NO: 1890 - DNA, 23 bp, Vaccinia Virus
gctaatgtctgttagacttttca

SEQ ID NO: 1891 - DNA, 17 bp, Vaccinia Virus
ccaccagacactccttc

SEQ ID NO: 1892 - DNA, 24 bp, Vaccinia Virus
ccaaaaaaacacaaagtgcttctg

SEQ ID NO: 1893 - DNA, 22 bp, Vaccinia Virus
tttgccaagaaaatctgggcct

SEQ ID NO: 1894 - DNA, 19 bp, Vaccinia Virus
gcggggaaatgttgagctc

SEQ ID NO: 1895 - DNA, 20 bp, Vaccinia Virus
ataaaattgggttcataaag

SEQ ID NO: 1896 - DNA, 18 bp, Vaccinia Virus
aaaaaagcatggaaaatg

SEQ ID NO: 1897 - DNA, 23 bp, Vaccinia Virus
aatatttttagattcttctgctc

SEQ ID NO: 1898 - DNA, 17 bp, Vaccinia Virus
tatgttgaatcaaagtg

SEQ ID NO: 1899 - DNA, 23 bp, Vaccinia Virus
gggtcattatcacttaaataata

SEQ ID NO: 1900 - DNA, 22 bp, Vaccinia Virus
agaactctgtatccatcagaga

SEQ ID NO: 1901 - DNA, 21 bp, Vaccinia Virus
cagctaacaatgtactacaga

SEQ ID NO: 1902 - DNA, 20 bp, Vaccinia Virus
agccgctgcaaaatcatgcc

SEQ ID NO: 1903 - DNA, 17 bp, Vaccinia Virus
gttagcaaggatatcca

SEQ ID NO: 1904 - DNA, 21 bp, Vaccinia Virus
aaaaataaaagcctgtagcta

SEQ ID NO: 1905 - DNA, 21 bp, Vaccinia Virus
ttctgcatccatatacaccct

SEQ ID NO: 1906 - DNA, 19 bp, Vaccinia Virus
aacatttgtttaattttta

SEQ ID NO: 1907 - DNA, 18 bp, Vaccinia Virus
agtagaagatgctacaga

SEQ ID NO: 1908 - DNA, 23 bp, Vaccinia Virus
ataaaaatgctcatgggaagtga

SEQ ID NO: 1909 - DNA, 18 bp, Vaccinia Virus
agccacctggccatgctg

SEQ ID NO: 1910 - DNA, 18 bp, Vaccinia Virus
ttattctgacaatgaaga

SEQ ID NO: 1911 - DNA, 18 bp, Vaccinia Virus
tgaaacttgtgccacaga

SEQ ID NO: 1912 - DNA, 19 bp, Vaccinia Virus
tgtccatacacagaaacat

SEQ ID NO: 1913 - DNA, 22 bp, Vaccinia Virus
attattgacttcaccacacccc

SEQ ID NO: 1914 - DNA, 15 bp, Vaccinia Virus
ctgttggtgtgctgc

SEQ ID NO: 1915 - DNA, 19 bp, Vaccinia Virus
aaatgaatggtctgtggaa

SEQ ID NO: 1916 - DNA, 17 bp, Vaccinia Virus
gaaatgaaatttgtagc

SEQ ID NO: 1917 - DNA, 23 bp, Vaccinia Virus
ctctgagtaccctggcgggaggc

SEQ ID NO: 1918 - DNA, 21 bp, Vaccinia Virus
cagccccagctgctcctcctc

SEQ ID NO: 1919 - DNA, 17 bp, Vaccinia Virus
ccattgcagattcgagt

SEQ ID NO: 1920 - DNA, 17 bp, Vaccinia Virus
ttgccaaaactccttct

SEQ ID NO: 1921 - DNA, 17 bp, Vaccinia Virus
ttcattgtataccacaa

SEQ ID NO: 1922 - DNA, 18 bp, Vaccinia Virus
agaaagagaacaatattt

SEQ ID NO: 1923 - DNA, 23 bp, Vaccinia Virus
ttgcaaggaaattgtgctttatc

SEQ ID NO: 1924 - DNA, 19 bp, Vaccinia Virus
atgttcttttaaattagtg

SEQ ID NO: 1925 - DNA, 21 bp, Vaccinia Virus
tatttttgtcttcttcctttc

SEQ ID NO: 1926 - DNA, 17 bp, Vaccinia Virus
ggagcctgcttgtggaa

SEQ ID NO: 1927 - DNA, 18 bp, Vaccinia Virus
ctacatatgagtataata

SEQ ID NO: 1928 - DNA, 20 bp, Vaccinia Virus
tttttattatcctcctctct

SEQ ID NO: 1929 - DNA, 22 bp, Vaccinia Virus
tttttattatcctcctctcttc

SEQ ID NO: 1930 - DNA, 19 bp, Vaccinia Virus
agatatggcatgtacttta

SEQ ID NO: 1931 - DNA, 18 bp, Vaccinia Virus
aaaaggcaaaggtattat

SEQ ID NO: 1932 - DNA, 17 bp, Vaccinia Virus
tctcataggagcataga

SEQ ID NO: 1933 - DNA, 23 bp, Vaccinia Virus
ttgtacaatattttgtacaaaga

SEQ ID NO: 1934 - DNA, 19 bp, Vaccinia Virus
tggtagtgcatgcctctaa

SEQ ID NO: 1935 - DNA, 20 bp, Vaccinia Virus
aactaaactgtattgttatt

SEQ ID NO: 1936 - DNA, 20 bp, Vaccinia Virus
atagatgagagcgtgcatgc

SEQ ID NO: 1937 - DNA, 22 bp, Vaccinia Virus
gacatgcaacagtcttttcact

SEQ ID NO: 1938 - DNA, 19 bp, Vaccinia Virus
tatactgtataacatgtta

SEQ ID NO: 1939 - DNA, 18 bp, Vaccinia Virus
ctcacagatggataaatg

SEQ ID NO: 1940 - DNA, 20 bp, Vaccinia Virus
atattaattagtttatatta

SEQ ID NO: 1941 - DNA, 18 bp, Vaccinia Virus
agctttcagaatatgtca

SEQ ID NO: 1942 - DNA, 18 bp, Vaccinia Virus
agagtacatgtattatat

SEQ ID NO: 1943 - DNA, 23 bp, Vaccinia Virus
atccctgctactgtcccttctca

SEQ ID NO: 1944 - DNA, 22 bp, Vaccinia Virus
tgactttcccacagagactgga

SEQ ID NO: 1945 - DNA, 23 bp, Vaccinia Virus
tatagttaataataaatgctgta

SEQ ID NO: 1946 - DNA, 19 bp, Vaccinia Virus
atctctgtcctcttgatta

SEQ ID NO: 1947 - DNA, 17 bp, Vaccinia Virus
ggcgctgtagacacaac

SEQ ID NO: 1948 - DNA, 19 bp, Vaccinia Virus
tggatcatctctacttctg

SEQ ID NO: 1949 - DNA, 19 bp, Vaccinia Virus
tgtatgaatagtaccaaag

SEQ ID NO: 1950 - DNA, 21 bp, Vaccinia Virus
atacatgggacttcacaaaca

SEQ ID NO: 1951 - DNA, 22 bp, Vaccinia Virus
ttctcaatcttgaactcataga

SEQ ID NO: 1952 - DNA, 22 bp, Vaccinia Virus
taatttatatctgtacatatta

SEQ ID NO: 1953 - DNA, 18 bp, Vaccinia Virus
aaagggggtgcagcgcgg

SEQ ID NO: 1954 - DNA, 22 bp, Vaccinia Virus
aacatcagggtgcagaattgat

SEQ ID NO: 1955 - DNA, 19 bp, Vaccinia Virus
accaaaactgcaatcagga

SEQ ID NO: 1956 - DNA, 25 bp, Vaccinia Virus
ctgcatctttacctatatccattta

SEQ ID NO: 1957 - DNA, 22 bp, Vaccinia Virus
taaaggtatgtgctatgataaa

SEQ ID NO: 1958 - DNA, 22 bp, Vaccinia Virus
taaaggtatgtgctatgataaa

SEQ ID NO: 1959 - DNA, 23 bp, Vaccinia Virus
agaattaggcttaaaaaatgcct

SEQ ID NO: 1960 - DNA, 22 bp, Vaccinia Virus
tgaagatgctatttctagaatt

SEQ ID NO: 1961 - DNA, 18 bp, Vaccinia Virus
aagctgttcgttgtatca

SEQ ID NO: 1962 - DNA, 21 bp, Vaccinia Virus
atttctggtgagtcagtccac

SEQ ID NO: 1963 - DNA, 20 bp, Vaccinia Virus
ccgtgttggccccagccacg

SEQ ID NO: 1964 - DNA, 19 bp, Vaccinia Virus
tgatgctgcagtggaaaac

SEQ ID NO: 1965 - DNA, 19 bp, Vaccinia Virus
aactgctaacttctattga

SEQ ID NO: 1966 - DNA, 18 bp, Vaccinia Virus
tatgctacccttaataac

SEQ ID NO: 1967 - DNA, 20 bp, Vaccinia Virus
tgatgtaggacttggaaaac

SEQ ID NO: 1968 - DNA, 18 bp, Vaccinia Virus
ccatatagcaagtttagt

SEQ ID NO: 1969 - DNA, 21 bp, Vaccinia Virus
ttggaaattgaagctgtagag

SEQ ID NO: 1970 - DNA, 17 bp, Vaccinia Virus
aggacttttatacctgt

SEQ ID NO: 1971 - DNA, 19 bp, Vaccinia Virus
tctgcatccatttgaacac

SEQ ID NO: 1972 - DNA, 22 bp, Vaccinia Virus
gaaatttcaatgataaaaaagg

SEQ ID NO: 1973 - DNA, 18 bp, Vaccinia Virus
gtacagttaacttataga

SEQ ID NO: 1974 - DNA, 21 bp, Vaccinia Virus
tgaagtatagggatgtattta

SEQ ID NO: 1975 - DNA, 19 bp, Vaccinia Virus
tgagtgtggtacattaact

SEQ ID NO: 1976 - DNA, 22 bp, Vaccinia Virus
tggaggtggtagatgccacaga

SEQ ID NO: 1977 - DNA, 21 bp, Vaccinia Virus
tgtttgaactggaaacttcaa

SEQ ID NO: 1978 - DNA, 17 bp, Vaccinia Virus
tgatcgcccggaagact

SEQ ID NO: 1979 - DNA, 20 bp, Vaccinia Virus
accgcaacaacttggtagga

SEQ ID NO: 1980 - DNA, 19 bp, Vaccinia Virus
tttttaagaatatattcta

SEQ ID NO: 1981 - DNA, 24 bp, Vaccinia Virus
taaaaaaagttttactgccatatt

SEQ ID NO: 1982 - DNA, 23 bp, Vaccinia Virus
gaaatagttctgtcaaaaatagt

SEQ ID NO: 1983 - DNA, 23 bp, Vaccinia Virus
gtaaataatcagaggggaataaa

SEQ ID NO: 1984 - DNA, 18 bp, Vaccinia Virus
ttcattcccaacacctta

SEQ ID NO: 1985 - DNA, 19 bp, Vaccinia Virus
ccatttaaatgggaataaa

SEQ ID NO: 1986 - DNA, 18 bp, Vaccinia Virus
tgtgtagacaaccaaaga

SEQ ID NO: 1987 - DNA, 18 bp, Vaccinia Virus
aaattttgctaccaaaga

SEQ ID NO: 1988 - DNA, 16 bp, Vaccinia Virus
catccttaaatgtcta

SEQ ID NO: 1989 - DNA, 24 bp, Vaccinia Virus
tgacactggcacaactgcaaacgg

SEQ ID NO: 1990 - DNA, 22 bp, Vaccinia Virus
aaaatattttactctgcctgat

SEQ ID NO: 1991 - DNA, 18 bp, Vaccinia Virus
tattctacttctctcttc

SEQ ID NO: 1992 - DNA, 20 bp, Vaccinia Virus
atgatattctagatactata

SEQ ID NO: 1993 - DNA, 20 bp, Vaccinia Virus
aggatatgtccacataagaa

SEQ ID NO: 1994 - DNA, 23 bp, Vaccinia Virus
ttggaaatcagaagtctgtgaga

SEQ ID NO: 1995 - DNA, 18 bp, Vaccinia Virus
atgaagcctttcagatac

SEQ ID NO: 1996 - DNA, 19 bp, Vaccinia Virus
tctatagtgatgaaacatt

SEQ ID NO: 1997 - DNA, 18 bp, Vaccinia Virus
gtccctttaaagcattga

SEQ ID NO: 1998 - DNA, 26 bp, Vaccinia Virus
tggtacaacccaggggtaaactatta

SEQ ID NO: 1999 - DNA, 20 bp, Vaccinia Virus
ttggtggctgccctgtggaa

SEQ ID NO: 2000 - DNA, 18 bp, Vaccinia Virus
tgaaaagatttggaagac

SEQ ID NO: 2001 - DNA, 16 bp, Vaccinia Virus
gtcatatgtggcagct

SEQ ID NO: 2002 - DNA, 16 bp, Vaccinia Virus
tactgcctatcaaacg

SEQ ID NO: 2003 - DNA, 18 bp, Vaccinia Virus
gactggagagccagaggc

SEQ ID NO: 2004 - DNA, 23 bp, Vaccinia Virus
tgaagtgtagatcattgtattca

SEQ ID NO: 2005 - DNA, 18 bp, Vaccinia Virus
ctcacaaagataaacatc

SEQ ID NO: 2006 - DNA, 19 bp, Vaccinia Virus
ttggaaattatgcactttg

SEQ ID NO: 2007 - DNA, 27 bp, Vaccinia Virus
ccaaaacataaacaataaatattctca

SEQ ID NO: 2008 - DNA, 18 bp, Vaccinia Virus
tcgagtccatatgtccac

SEQ ID NO: 2009 - DNA, 17 bp, Vaccinia Virus
attgaatactccatccc

SEQ ID NO: 2010 - DNA, 21 bp, Vaccinia Virus
accaaggctgccacgctctaa

SEQ ID NO: 2011 - DNA, 18 bp, Vaccinia Virus
agccacagaaaccacgtt

SEQ ID NO: 2012 - DNA, 18 bp, Vaccinia Virus
agccacagaaaccacgtt

SEQ ID NO: 2013 - DNA, 21 bp, Vaccinia Virus
agatatgtaaataagctctca

SEQ ID NO: 2014 - DNA, 16 bp, Vaccinia Virus
cctgatgtgtacctta

SEQ ID NO: 2015 - DNA, 21 bp, Vaccinia Virus
aatggccggggacttataaat

SEQ ID NO: 2016 - DNA, 22 bp, Vaccinia Virus
agggaacaccagttttcacatg

SEQ ID NO: 2017 - DNA, 19 bp, Vaccinia Virus
acaagcaaatgtaactcca

SEQ ID NO: 2018 - DNA, 18 bp, Vaccinia Virus
aaactagaacaggtatat

SEQ ID NO: 2019 - DNA, 22 bp, Vaccinia Virus
aatggtgggtctataaatttgt

SEQ ID NO: 2020 - DNA, 18 bp, Vaccinia Virus
acaaatatcataaaagga

SEQ ID NO: 2021 - DNA, 18 bp, Vaccinia Virus
gtagcacaatctataatt

SEQ ID NO: 2022 - DNA, 18 bp, Vaccinia Virus
aatggcgttttataaatt

SEQ ID NO: 2023 - DNA, 21 bp, Vaccinia Virus
accctgtcattacgtcaacgc

SEQ ID NO: 2024 - DNA, 21 bp, Vaccinia Virus
accctgtcattacgtcaacgc

SEQ ID NO: 2025 - DNA, 19 bp, Vaccinia Virus
aggctttcaaaagccaaag

SEQ ID NO: 2026 - DNA, 21 bp, Vaccinia Virus
accctgtcattacgtcaacgc

SEQ ID NO: 2027 - DNA, 21 bp, Vaccinia Virus
accctgtcattacgtcaacgc

SEQ ID NO: 2028 - DNA, 21 bp, Vaccinia Virus
accctgtcattacgtcaacgc

SEQ ID NO: 2029 - DNA, 21 bp, Vaccinia Virus
tgtacagtatgtaaatgctat

SEQ ID NO: 2030 - DNA, 18 bp, Vaccinia Virus
atattgcatccctagaga

SEQ ID NO: 2031 - DNA, 18 bp, Vaccinia Virus
ccgcagcgcgcggaggaa

SEQ ID NO: 2032 - DNA, 22 bp, Vaccinia Virus
ggtgacagagtgagtgagactc

SEQ ID NO: 2033 - DNA, 18 bp, Vaccinia Virus
ccgcagcgcgcggaggaa

SEQ ID NO: 2034 - DNA, 22 bp, Vaccinia Virus
ggtgacagagtgagtgagactc

SEQ ID NO: 2035 - DNA, 18 bp, Vaccinia Virus
ccgcagcgcgcggaggaa

SEQ ID NO: 2036 - DNA, 18 bp, Vaccinia Virus
ccgcagcgcgcggaggaa

SEQ ID NO: 2037 - DNA, 22 bp, Vaccinia Virus
aatacaggatgaaaaacactga

SEQ ID NO: 2038 - DNA, 20 bp, Vaccinia Virus
agcgaattggttacatcgtt

SEQ ID NO: 2039 - DNA, 23 bp, Vaccinia Virus
acaaaagggtatttcttttctct

SEQ ID NO: 2040 - DNA, 18 bp, Vaccinia Virus
tatttcttttctctcttc

SEQ ID NO: 2041 - DNA, 23 bp, Vaccinia Virus
ttgtgtgaaacccctagcataga

SEQ ID NO: 2042 - DNA, 18 bp, Vaccinia Virus
ccttacaatccgagacta

SEQ ID NO: 2043 - DNA, 16 bp, Vaccinia Virus
tctgcatccatgccac

SEQ ID NO: 2044 - DNA, 18 bp, Vaccinia Virus
gaaaaggaagcatgtagc

SEQ ID NO: 2045 - DNA, 18 bp, Vaccinia Virus
tgtagtggaaagaagcat

SEQ ID NO: 2046 - DNA, 16 bp, Vaccinia Virus
cccttcttctactcca

SEQ ID NO: 2047 - DNA, 19 bp, Vaccinia Virus
ccgcgttttcctgtgctgc

SEQ ID NO: 2048 - DNA, 19 bp, Vaccinia Virus
tccttgctctggtaaaaga

SEQ ID NO: 2049 - DNA, 17 bp, Vaccinia Virus
tctcagaaagtcttcaa

SEQ ID NO: 2050 - DNA, 19 bp, Vaccinia Virus
ccactgattggctggtgta

SEQ ID NO: 2051 - DNA, 21 bp, Vaccinia Virus
tctctgccaggaccccataga

SEQ ID NO: 2052 - DNA, 22 bp, Vaccinia Virus
tcctattgaaggaaccaccccc

SEQ ID NO: 2053 - DNA, 22 bp, Vaccinia Virus
gcccccgggaagagccaaaggc

SEQ ID NO: 2054 - DNA, 25 bp, Vaccinia Virus
gacaaaagcaaggccccttttcact

SEQ ID NO: 2055 - DNA, 18 bp, Vaccinia Virus
ccctcatgtctggtaaaa

SEQ ID NO: 2056 - DNA, 18 bp, Vaccinia Virus
agaaatggatagctttaa

SEQ ID NO: 2057 - DNA, 16 bp, Vaccinia Virus
gcttaagccagagcta

SEQ ID NO: 2058 - DNA, 18 bp, Vaccinia Virus
gagaattaaaatatttta

SEQ ID NO: 2059 - DNA, 17 bp, Vaccinia Virus
acagcattacaaaatcc

SEQ ID NO: 2060 - DNA, 24 bp, Vaccinia Virus
taaaatctatgtgttttagactta

SEQ ID NO: 2061 - DNA, 23 bp, Vaccinia Virus
tactgcactaccaaattcatttg

SEQ ID NO: 2062 - DNA, 21 bp, Vaccinia Virus
aatacaggaaacaagaggtac

SEQ ID NO: 2063 - DNA, 24 bp, Vaccinia Virus
aggacttttgtggggccacaagta

SEQ ID NO: 2064 - DNA, 22 bp, Vaccinia Virus
cagtcaggccccaggttcttcc

SEQ ID NO: 2065 - DNA, 19 bp, Vaccinia Virus
gttgatagccctctagtca

SEQ ID NO: 2066 - DNA, 25 bp, Vaccinia Virus
gctctgtattaaaacaaatccacca

SEQ ID NO: 2067 - DNA, 21 bp, Vaccinia Virus
ttgagatggaagagtctttaa

SEQ ID NO: 2068 - DNA, 24 bp, Vaccinia Virus
agcaaatttggctcgataatatcg

SEQ ID NO: 2069 - DNA, 19 bp, Vaccinia Virus
actaaaatactgttattgg

SEQ ID NO: 2070 - DNA, 20 bp, Vaccinia Virus
accagaatctccactgtagt

SEQ ID NO: 2071 - DNA, 17 bp, Vaccinia Virus
tttatgtaaacatacca

SEQ ID NO: 2072 - DNA, 18 bp, Vaccinia Virus
gattcatcattattccta

SEQ ID NO: 2073 - DNA, 20 bp, Vaccinia Virus
ggaattgcggaaaacaggac

SEQ ID NO: 2074 - DNA, 21 bp, Vaccinia Virus
gaagggggagcaggcacatca

SEQ ID NO: 2075 - DNA, 22 bp, Vaccinia Virus
tgtgcaaaattttagtatcaga

SEQ ID NO: 2076 - DNA, 19 bp, Vaccinia Virus
aacgatgatgatgaacaca

SEQ ID NO: 2077 - DNA, 18 bp, Vaccinia Virus
gccatgaatggtgccctt

SEQ ID NO: 2078 - DNA, 18 bp, Vaccinia Virus
atgaataaacatatcttg

SEQ ID NO: 2079 - DNA, 18 bp, Vaccinia Virus
tattctttttttcccttc

SEQ ID NO: 2080 - DNA, 17 bp, Vaccinia Virus
tactcactgtacttgta

SEQ ID NO: 2081 - DNA, 21 bp, Vaccinia Virus
tgcgacccccctgccccgaat

SEQ ID NO: 2082 - DNA, 17 bp, Vaccinia Virus
tgcttgacaaattggat

SEQ ID NO: 2083 - DNA, 22 bp, Vaccinia Virus
tctggcatgataaaatcatgga

SEQ ID NO: 2084 - DNA, 24 bp, Vaccinia Virus
tgataccactaagaagaagattta

SEQ ID NO: 2085 - DNA, 21 bp, Vaccinia Virus
gatgatgtcattacttctata

SEQ ID NO: 2086 - DNA, 26 bp, Vaccinia Virus
tttacaggtaccatgcagagaacaaa

SEQ ID NO: 2087 - DNA, 22 bp, Vaccinia Virus
cagacgtggtgtggtgcacacc

SEQ ID NO: 2088 - DNA, 22 bp, Vaccinia Virus
ggcaacaggagaatgtcaagcc

SEQ ID NO: 2089 - DNA, 21 bp, Vaccinia Virus
tgatgtggaaacctacttctg

SEQ ID NO: 2090 - DNA, 22 bp, Vaccinia Virus
caaaacctgaaactttaaagga

SEQ ID NO: 2091 - DNA, 20 bp, Vaccinia Virus
ctggtgctactggtctttct

SEQ ID NO: 2092 - DNA, 19 bp, Vaccinia Virus
gtcattgcatggtgaaagc

SEQ ID NO: 2093 - DNA, 19 bp, Vaccinia Virus
tctcagggtgggacccata

SEQ ID NO: 2094 - DNA, 20 bp, Vaccinia Virus
caggtgaggaccattttcac

SEQ ID NO: 2095 - DNA, 19 bp, Vaccinia Virus
gaaagctcacttccatgaa

SEQ ID NO: 2096 - DNA, 19 bp, Vaccinia Virus
gcttctgtcatctccagag

SEQ ID NO: 2097 - DNA, 21 bp, Vaccinia Virus
tggaaaggggaatctatgcca

SEQ ID NO: 2098 - DNA, 19 bp, Vaccinia Virus
tagtcacaaagataatacc

SEQ ID NO: 2099 - DNA, 19 bp, Vaccinia Virus
caaaacgagtaaagagcag

SEQ ID NO: 2100 - DNA, 23 bp, Vaccinia Virus
tgatgttacttgccacctacttc

SEQ ID NO: 2101 - DNA, 17 bp, Vaccinia Virus
aggcagaaggatcactt

SEQ ID NO: 2102 - DNA, 21 bp, Vaccinia Virus
tccaggagatggaccaacaga

SEQ ID NO: 2103 - DNA, 19 bp, Vaccinia Virus
tgtatcattttgtaccaaa

SEQ ID NO: 2104 - DNA, 19 bp, Vaccinia Virus
tcccctctaccaatccctg

SEQ ID NO: 2105 - DNA, 18 bp, Vaccinia Virus
actgcagtactgtttgta

SEQ ID NO: 2106 - DNA, 22 bp, Vaccinia Virus
aacatcttcaacacagaacaca

SEQ ID NO: 2107 - DNA, 18 bp, Vaccinia Virus
atagtttaaacatgcaac

SEQ ID NO: 2108 - DNA, 24 bp, Vaccinia Virus
gccatagaattctctccagaagag

SEQ ID NO: 2109 - DNA, 18 bp, Vaccinia Virus
ttctctccctttctcttc

SEQ ID NO: 2110 - DNA, 19 bp, Vaccinia Virus
ctagaacaggatgtcctgc

SEQ ID NO: 2111 - DNA, 20 bp, Vaccinia Virus
atctctgtctacaaaactag

SEQ ID NO: 2112 - DNA, 19 bp, Vaccinia Virus
ggaataaatttcacatgaa

SEQ ID NO: 2113 - DNA, 22 bp, Vaccinia Virus
tgatgccaactcccccgcactt

SEQ ID NO: 2114 - DNA, 19 bp, Vaccinia Virus
gaaccatgctgctacccaa

SEQ ID NO: 2115 - DNA, 19 bp, Vaccinia Virus
gtcatatttttgaaagtta

SEQ ID NO: 2116 - DNA, 20 bp, Vaccinia Virus
gtgtgaaatttactagcaaa

SEQ ID NO: 2117 - DNA, 23 bp, Vaccinia Virus
tctccagggccacaactgtcaca

SEQ ID NO: 2118 - DNA, 19 bp, Vaccinia Virus
ggccgagggacaaaggcta

SEQ ID NO: 2119 - DNA, 19 bp, Vaccinia Virus
agtgagccgagaccatgcc

SEQ ID NO: 2120 - DNA, 20 bp, Vaccinia Virus
atagatctaaatacaaagga

SEQ ID NO: 2121 - DNA, 18 bp, Vaccinia Virus
tgctagagtaatgctata

SEQ ID NO: 2122 - DNA, 19 bp, Vaccinia Virus
gctaatgaaaatgttttct

SEQ ID NO: 2123 - DNA, 23 bp, Vaccinia Virus
acttgagcaaataattgggatga

SEQ ID NO: 2124 - DNA, 20 bp, Vaccinia Virus
tagtcacttgccaccatgcc

SEQ ID NO: 2125 - DNA, 19 bp, Vaccinia Virus
agaacgctggactttaatg

SEQ ID NO: 2126 - DNA, 19 bp, Vaccinia Virus
gaatattctacctaaatat

SEQ ID NO: 2127 - DNA, 22 bp, Vaccinia Virus
gaaaaacggaggattaaaacca

SEQ ID NO: 2128 - DNA, 21 bp, Vaccinia Virus
tggtacagcacacatgtgagc

SEQ ID NO: 2129 - DNA, 17 bp, Vaccinia Virus
tcatacacacagataaa

SEQ ID NO: 2130 - DNA, 19 bp, Vaccinia Virus
gaggcagaaaattccactt

SEQ ID NO: 2131 - DNA, 21 bp, Vaccinia Virus
atatagtgagaccctatttct

SEQ ID NO: 2132 - DNA, 18 bp, Vaccinia Virus
ttttgtaaatgatgagaa

SEQ ID NO: 2133 - DNA, 18 bp, Vaccinia Virus
agagaaagacaagggttt

SEQ ID NO: 2134 - DNA, 18 bp, Vaccinia Virus
agaatatagtttatctta

SEQ ID NO: 2135 - DNA, 19 bp, Vaccinia Virus
aagtaaagatttatctgat

SEQ ID NO: 2136 - DNA, 19 bp, Vaccinia Virus
tagtgtttagaatatctaa

SEQ ID NO: 2137 - DNA, 24 bp, Vaccinia Virus
gacaaagtgatgttttcttcccat

SEQ ID NO: 2138 - DNA, 19 bp, Vaccinia Virus
gaggcttattaaaaatagt

SEQ ID NO: 2139 - DNA, 20 bp, Vaccinia Virus
agagaaagattttagctttt

SEQ ID NO: 2140 - DNA, 20 bp, Vaccinia Virus
atgtttatgcacactttata

SEQ ID NO: 2141 - DNA, 22 bp, Vaccinia Virus
tagaaatgttctcagactttaa

SEQ ID NO: 2142 - DNA, 18 bp, Vaccinia Virus
tggcgtgagatgttatct

SEQ ID NO: 2143 - DNA, 21 bp, Vaccinia Virus
ccatctaatgttttaaaaggc

SEQ ID NO: 2144 - DNA, 18 bp, Vaccinia Virus
ggtaatttatagaacaaa

SEQ ID NO: 2145 - DNA, 22 bp, Vaccinia Virus
atctctgttccccatccccagt

SEQ ID NO: 2146 - DNA, 18 bp, Vaccinia Virus
ctcttaaatactgtacta

SEQ ID NO: 2147 - DNA, 18 bp, Vaccinia Virus
aagtagaaaggtatatca

SEQ ID NO: 2148 - DNA, 19 bp, Vaccinia Virus
ttctgcccaccactcacgg

SEQ ID NO: 2149 - DNA, 19 bp, Vaccinia Virus
gtgacttcccagcactaga

SEQ ID NO: 2150 - DNA, 19 bp, Vaccinia Virus
tctgttttttctaccctag

SEQ ID NO: 2151 - DNA, 19 bp, Vaccinia Virus
aaaaaaaattaaggggaaa

SEQ ID NO: 2152 - DNA, 18 bp, Vaccinia Virus
gatgccacatagtcttgc

SEQ ID NO: 2153 - DNA, 21 bp, Vaccinia Virus
cagccccgactgctcctcctc

SEQ ID NO: 2154 - DNA, 18 bp, Vaccinia Virus
agtcaaaatatattacat

SEQ ID NO: 2155 - DNA, 19 bp, Vaccinia Virus
gaagcaccgggaagactta

SEQ ID NO: 2156 - DNA, 19 bp, Vaccinia Virus
gaagcaccgggaagactta

SEQ ID NO: 2157 - DNA, 19 bp, Vaccinia Virus
gaagcaccgggaagactta

SEQ ID NO: 2158 - DNA, 19 bp, Vaccinia Virus
gaagcaccgggaagactta

SEQ ID NO: 2159 - DNA, 20 bp, Vaccinia Virus
gtcagacagcaaggaactgt

SEQ ID NO: 2160 - DNA, 22 bp, Vaccinia Virus
aagtccaaactgatatatccta

SEQ ID NO: 2161 - DNA, 18 bp, Vaccinia Virus
gataccagataatcacaa

SEQ ID NO: 2162 - DNA, 22 bp, Vaccinia Virus
tatgtaaggggtgagacacaac

SEQ ID NO: 2163 - DNA, 19 bp, Vaccinia Virus
tcaagtgcatctattccca

SEQ ID NO: 2164 - DNA, 18 bp, Vaccinia Virus
atttatcgtaaacatcca

SEQ ID NO: 2165 - DNA, 23 bp, Vaccinia Virus
atggactgaatcacatagattct

SEQ ID NO: 2166 - DNA, 22 bp, Vaccinia Virus
atccaatactaaatacccctta

SEQ ID NO: 2167 - DNA, 19 bp, Vaccinia Virus
atgaagaatctcaggctgc

SEQ ID NO: 2168 - DNA, 17 bp, Vaccinia Virus
tctactaaaactacaaa

SEQ ID NO: 2169 - DNA, 18 bp, Vaccinia Virus
aaacaaaactgtagaagc

SEQ ID NO: 2170 - DNA, 24 bp, Vaccinia Virus
ttctaaggggaagggacccataga

SEQ ID NO: 2171 - DNA, 17 bp, Vaccinia Virus
atgaatgcaaacacatg

SEQ ID NO: 2172 - DNA, 23 bp, Vaccinia Virus
aaaaagtttaccatcattttgga

SEQ ID NO: 2173 - DNA, 26 bp, Vaccinia Virus
aaagaaaggcaccatcagacaaaaga

SEQ ID NO: 2174 - DNA, 18 bp, Vaccinia Virus
tctcacaaatataaaacc

SEQ ID NO: 2175 - DNA, 19 bp, Vaccinia Virus
acagacaatgcaggggcag

SEQ ID NO: 2176 - DNA, 17 bp, Vaccinia Virus
aggcagaagaatcactt

SEQ ID NO: 2177 - DNA, 16 bp, Vaccinia Virus
tctactaaactacaaa

SEQ ID NO: 2178 - DNA, 18 bp, Vaccinia Virus
tagaacatttaccgatgc

SEQ ID NO: 2179 - DNA, 20 bp, Vaccinia Virus
atgcatatacatacatgata

SEQ ID NO: 2180 - DNA, 22 bp, Vaccinia Virus
ttatagacactagtaggacaaa

SEQ ID NO: 2181 - DNA, 21 bp, Vaccinia Virus
gaatccccaacacccaataaa

SEQ ID NO: 2182 - DNA, 18 bp, Vaccinia Virus
acactctgagaaagagca

SEQ ID NO: 2183 - DNA, 19 bp, Vaccinia Virus
ttttggtggctcgatgtta

SEQ ID NO: 2184 - DNA, 18 bp, Vaccinia Virus
gcagtgagtgctgagctc

SEQ ID NO: 2185 - DNA, 23 bp, Vaccinia Virus
aaaaagcagaggccaagagtttg

SEQ ID NO: 2186 - DNA, 19 bp, Vaccinia Virus
attttgtgaatggattgga

SEQ ID NO: 2187 - DNA, 18 bp, Vaccinia Virus
ccacatagcaaggtctga

SEQ ID NO: 2188 - DNA, 23 bp, Vaccinia Virus
gaaaaaacaaagttctgcatgag

SEQ ID NO: 2189 - DNA, 21 bp, Vaccinia Virus
gcaatttacacacttgtctca

SEQ ID NO: 2190 - DNA, 17 bp, Vaccinia Virus
acagctgtagtaactat

SEQ ID NO: 2191 - DNA, 17 bp, Vaccinia Virus
tgaagtgttcacattca

SEQ ID NO: 2192 - DNA, 18 bp, Vaccinia Virus
agccccgccccctcctcg

SEQ ID NO: 2193 - DNA, 18 bp, Vaccinia Virus
aaagagaaaaatatttta

SEQ ID NO: 2194 - DNA, 16 bp, Vaccinia Virus
agtctttgtagataaa

SEQ ID NO: 2195 - DNA, 18 bp, Vaccinia Virus
agtagaccgaaaccatcc

SEQ ID NO: 2196 - DNA, 21 bp, Vaccinia Virus
aaaatattgcattcttctgat

SEQ ID NO: 2197 - DNA, 22 bp, Vaccinia Virus
aactaaacattctctgttctga

SEQ ID NO: 2198 - DNA, 17 bp, Vaccinia Virus
taatgtttggaatggag

SEQ ID NO: 2199 - DNA, 18 bp, Vaccinia Virus
tccagagcattccttcta

SEQ ID NO: 2200 - DNA, 19 bp, Vaccinia Virus
agtctaggaaaccatgctg

SEQ ID NO: 2201 - DNA, 20 bp, Vaccinia Virus
gcagttgttctttaatctcc

SEQ ID NO: 2202 - DNA, 25 bp, Vaccinia Virus
aaaaagttgaacaaagatgaactaa

SEQ ID NO: 2203 - DNA, 23 bp, Vaccinia Virus
agatgaactaatgtattacatta

SEQ ID NO: 2204 - DNA, 20 bp, Vaccinia Virus
ccactgatttttttttaaat

SEQ ID NO: 2205 - DNA, 21 bp, Vaccinia Virus
tctgttgtcagaggctcacgg

SEQ ID NO: 2206 - DNA, 21 bp, Vaccinia Virus
cagccccatctcctcctcctc

SEQ ID NO: 2207 - DNA, 18 bp, Vaccinia Virus
cagaaatatcatcttgga

SEQ ID NO: 2208 - DNA, 18 bp, Vaccinia Virus
ctagacaaagctacccag

SEQ ID NO: 2209 - DNA, 17 bp, Vaccinia Virus
tgccaggctttgccaaa

SEQ ID NO: 2210 - DNA, 23 bp, Vaccinia Virus
aagctgctgacgcaaacaacaac

SEQ ID NO: 2211 - DNA, 25 bp, Vaccinia Virus
ccacccctttaaggagttggtaaaa

SEQ ID NO: 2212 - DNA, 18 bp, Vaccinia Virus
tcaacaaatgtgagtcat

SEQ ID NO: 2213 - DNA, 23 bp, Vaccinia Virus
gatacctacaactcctaggaaga

SEQ ID NO: 2214 - DNA, 17 bp, Vaccinia Virus
agccacagaaggcgccg

SEQ ID NO: 2215 - DNA, 24 bp, Vaccinia Virus
caaaggcaagctaacaaagttcaa

SEQ ID NO: 2216 - DNA, 18 bp, Vaccinia Virus
tatagaccattaagaata

SEQ ID NO: 2217 - DNA, 19 bp, Vaccinia Virus
tttgtttttagttatctta

SEQ ID NO: 2218 - DNA, 18 bp, Vaccinia Virus
ttaccctctcctctcttc

SEQ ID NO: 2219 - DNA, 28 bp, Vaccinia Virus
gcaggaacacaattaggatattttcata

SEQ ID NO: 2220 - DNA, 16 bp, Vaccinia Virus
gaaaaagactttgata

SEQ ID NO: 2221 - DNA, 23 bp, Vaccinia Virus
caggaatagtcagcatttcacat

SEQ ID NO: 2222 - DNA, 20 bp, Vaccinia Virus
ttaccttgcagacggaatga

SEQ ID NO: 2223 - DNA, 21 bp, Vaccinia Virus
tgtctttatttttaccaaaga

SEQ ID NO: 2224 - DNA, 19 bp, Vaccinia Virus
ggcagtaagtgtccagctc

SEQ ID NO: 2225 - DNA, 23 bp, Vaccinia Virus
atattgcaaaaaactacagctaa

SEQ ID NO: 2226 - DNA, 24 bp, Vaccinia Virus
tattttcatcagcttcttctctct

SEQ ID NO: 2227 - DNA, 22 bp, Vaccinia Virus
gatctaatctgatcatttaata

SEQ ID NO: 2228 - DNA, 21 bp, Vaccinia Virus
actgaaacccggaacagattc

SEQ ID NO: 2229 - DNA, 20 bp, Vaccinia Virus
aggcagggtctaacccttca

SEQ ID NO: 2230 - DNA, 17 bp, Vaccinia Virus
tctgctctctacccact

SEQ ID NO: 2231 - DNA, 21 bp, Vaccinia Virus
tatcctcttaaccttctcttc

SEQ ID NO: 2232 - DNA, 21 bp, Vaccinia Virus
cactacaattatgcttttgta

SEQ ID NO: 2233 - DNA, 25 bp, Vaccinia Virus
ttctgcatctacaactcaacattta

SEQ ID NO: 2234 - DNA, 23 bp, Vaccinia Virus
gtccagagttaactgccctgctg

SEQ ID NO: 2235 - DNA, 16 bp, Vaccinia Virus
caatgagggtgtcatg

SEQ ID NO: 2236 - DNA, 17 bp, Vaccinia Virus
ggggccagaatatctca

SEQ ID NO: 2237 - DNA, 18 bp, Vaccinia Virus
ggacaaagctcacatgaa

SEQ ID NO: 2238 - DNA, 20 bp, Vaccinia Virus
aaaaggcagaaatccattca

SEQ ID NO: 2239 - DNA, 18 bp, Vaccinia Virus
atccacaatccaattacc

SEQ ID NO: 2240 - DNA, 22 bp, Vaccinia Virus
cagatgcggtggctcacaccta

SEQ ID NO: 2241 - DNA, 17 bp, Vaccinia Virus
tggaaatccgtgtgtaa

SEQ ID NO: 2242 - DNA, 18 bp, Vaccinia Virus
tttattctctctgtctct

SEQ ID NO: 2243 - DNA, 20 bp, Vaccinia Virus
tagtcacagacacaggagcc

SEQ ID NO: 2244 - DNA, 19 bp, Vaccinia Virus
ctctgaggcccaggggagc

SEQ ID NO: 2245 - DNA, 20 bp, Vaccinia Virus
cagctggaagacattcctcc

SEQ ID NO: 2246 - DNA, 18 bp, Vaccinia Virus
caatgagaaaggagagta

SEQ ID NO: 2247 - DNA, 19 bp, Vaccinia Virus
atggaaggacttcagatac

SEQ ID NO: 2248 - DNA, 19 bp, Vaccinia Virus
ccaaatgtaagtgccatga

SEQ ID NO: 2249 - DNA, 22 bp, Vaccinia Virus
attttgaggactttttctctct

SEQ ID NO: 2250 - DNA, 18 bp, Vaccinia Virus
gtacagttaacttataga

SEQ ID NO: 2251 - DNA, 20 bp, Vaccinia Virus
gaaataattgctctgttgaa

SEQ ID NO: 2252 - DNA, 18 bp, Vaccinia Virus
aaaaaagcatggaaaatg

SEQ ID NO: 2253 - DNA, 20 bp, Vaccinia Virus
gaaataattgctctgttgaa

SEQ ID NO: 2254 - DNA, 18 bp, Vaccinia Virus
atgttgaaagacttagtg

SEQ ID NO: 2255 - DNA, 18 bp, Vaccinia Virus
gagaataaaaagatttta

SEQ ID NO: 2256 - DNA, 16 bp, Vaccinia Virus
gtcaagtggaaagcta

SEQ ID NO: 2257 - DNA, 20 bp, Vaccinia Virus
tttcgttttcctctctcttc

SEQ ID NO: 2258 - DNA, 21 bp, Vaccinia Virus
ttctacacactcagccacaaa

SEQ ID NO: 2259 - DNA, 18 bp, Vaccinia Virus
tgattaactggccaataa

SEQ ID NO: 2260 - DNA, 19 bp, Vaccinia Virus
tatacctctcactcattca

SEQ ID NO: 2261 - DNA, 19 bp, Vaccinia Virus
ctgggagcagaactagaaa

SEQ ID NO: 2262 - DNA, 23 bp, Vaccinia Virus
gctaagaatgaaaaagacttctc

SEQ ID NO: 2263 - DNA, 19 bp, Vaccinia Virus
aaggaacttttgtataata

SEQ ID NO: 2264 - DNA, 24 bp, Vaccinia Virus
actcatcagaccatgcactatgga

SEQ ID NO: 2265 - DNA, 18 bp, Vaccinia Virus
cttaagtctggtccctca

SEQ ID NO: 2266 - DNA, 20 bp, Vaccinia Virus
aggctgggctgagccaaagc

SEQ ID NO: 2267 - DNA, 18 bp, Vaccinia Virus
aaaaagctggtggtgaac

SEQ ID NO: 2268 - DNA, 23 bp, Vaccinia Virus
aagtaaaaatagtaagagatgtt

SEQ ID NO: 2269 - DNA, 22 bp, Vaccinia Virus
ccatgttagtgctacattgtgc

SEQ ID NO: 2270 - DNA, 18 bp, Vaccinia Virus
cactacgctgccatttta

SEQ ID NO: 2271 - DNA, 21 bp, Vaccinia Virus
aacagcataaacagctggacc

SEQ ID NO: 2272 - DNA, 21 bp, Vaccinia Virus
tgtacagtctaaagctacaga

SEQ ID NO: 2273 - DNA, 17 bp, Vaccinia Virus
tagatctgtacctagta

SEQ ID NO: 2274 - DNA, 18 bp, Vaccinia Virus
atgaagacccagatacta

SEQ ID NO: 2275 - DNA, 18 bp, Vaccinia Virus
caaaacatcagataatat

SEQ ID NO: 2276 - DNA, 21 bp, Vaccinia Virus
gttgaaggacaccagctgcgg

SEQ ID NO: 2277 - DNA, 22 bp, Vaccinia Virus
aaacgatgatgcaggctattca

SEQ ID NO: 2278 - DNA, 20 bp, Vaccinia Virus
aaaagattttattaaagata

SEQ ID NO: 2279 - DNA, 17 bp, Vaccinia Virus
gccacagaaacataagt

SEQ ID NO: 2280 - DNA, 18 bp, Vaccinia Virus
gtacacagatgctacaga

SEQ ID NO: 2281 - DNA, 19 bp, Vaccinia Virus
tcttcttcaattcctgcta

SEQ ID NO: 2282 - DNA, 18 bp, Vaccinia Virus
tcatctgggagtccccaa

SEQ ID NO: 2283 - DNA, 20 bp, Vaccinia Virus
gaacttgaagactgcagagc

SEQ ID NO: 2284 - DNA, 17 bp, Vaccinia Virus
tactgcctgtgctgcta

SEQ ID NO: 2285 - DNA, 20 bp, Vaccinia Virus
tatctctgccttccaggcat

SEQ ID NO: 2286 - DNA, 24 bp, Vaccinia Virus
aaaattagttgttacctcctcaca

SEQ ID NO: 2287 - DNA, 20 bp, Vaccinia Virus
atttgtatatctatctacca

SEQ ID NO: 2288 - DNA, 19 bp, Vaccinia Virus
agtcggaaaaccatcgccg

SEQ ID NO: 2289 - DNA, 18 bp, Vaccinia Virus
gttctgttgtctaaaagc

SEQ ID NO: 2290 - DNA, 24 bp, Vaccinia Virus
tgtgactttcctggtgcatccagg

SEQ ID NO: 2291 - DNA, 18 bp, Vaccinia Virus
agtcacagctgggcttcc

SEQ ID NO: 2292 - DNA, 18 bp, Vaccinia Virus
aaagaaataaatgacaat

SEQ ID NO: 2293 - DNA, 23 bp, Vaccinia Virus
cagctgggcctgcagttcctccc

SEQ ID NO: 2294 - DNA, 16 bp, Vaccinia Virus
caatgggggagacata

SEQ ID NO: 2295 - DNA, 22 bp, Vaccinia Virus
acaaatctccaagaaaacagct

SEQ ID NO: 2296 - DNA, 17 bp, Vaccinia Virus
tctactaaaactacaaa

SEQ ID NO: 2297 - DNA, 22 bp, Vaccinia Virus
cctgctgaaaaccctccagtca

SEQ ID NO: 2298 - DNA, 21 bp, Vaccinia Virus
acagcacacaagtggctattg

SEQ ID NO: 2299 - DNA, 20 bp, Vaccinia Virus
tattttcacattttctctct

SEQ ID NO: 2300 - DNA, 21 bp, Vaccinia Virus
acagcacacaagtggctattg

SEQ ID NO: 2301 - DNA, 20 bp, Vaccinia Virus
tattttcacattttctctct

SEQ ID NO: 2302 - DNA, 21 bp, Vaccinia Virus
acagcacacaagtggctattg

SEQ ID NO: 2303 - DNA, 20 bp, Vaccinia Virus
tattttcacattttctctct

SEQ ID NO: 2304 - DNA, 18 bp, Vaccinia Virus
acagggaacaaagaaaca

SEQ ID NO: 2305 - DNA, 23 bp, Vaccinia Virus
gaaacaaaatcctcaggaaatta

SEQ ID NO: 2306 - DNA, 21 bp, Vaccinia Virus
ttcccctttccccactccctg

SEQ ID NO: 2307 - DNA, 17 bp, Vaccinia Virus
acagcattacaaaatcc

SEQ ID NO: 2308 - DNA, 20 bp, Vaccinia Virus
atttattctgaacgggagaa

SEQ ID NO: 2309 - DNA, 18 bp, Vaccinia Virus
tttattccatttctctct

SEQ ID NO: 2310 - DNA, 21 bp, Vaccinia Virus
gtatgttgaacccaaactgtg

SEQ ID NO: 2311 - DNA, 23 bp, Vaccinia Virus
ataaagccaggtacacgaggcag

SEQ ID NO: 2312 - DNA, 23 bp, Vaccinia Virus
agcaccaacagcacagttcttca

SEQ ID NO: 2313 - DNA, 21 bp, Vaccinia Virus
cattaaaataacctgaaggaa

SEQ ID NO: 2314 - DNA, 18 bp, Vaccinia Virus
aagtagaaaggtatatca

SEQ ID NO: 2315 - DNA, 20 bp, Vaccinia Virus
tcccctctccacccacccca

SEQ ID NO: 2316 - DNA, 23 bp, Vaccinia Virus
ctaatatccagaatctacaaaga

SEQ ID NO: 2317 - DNA, 20 bp, Vaccinia Virus
gtgctgaaatccacgccaga

SEQ ID NO: 2318 - DNA, 20 bp, Vaccinia Virus
gtgctgaaatccacgccaga

SEQ ID NO: 2319 - DNA, 20 bp, Vaccinia Virus
gtgctgaaatccacgccaga

SEQ ID NO: 2320 - DNA, 21 bp, Vaccinia Virus
agatcagagactgtaaaaagt

SEQ ID NO: 2321 - DNA, 20 bp, Vaccinia Virus
gtgctgaaatccacgccaga

SEQ ID NO: 2322 - DNA, 23 bp, Vaccinia Virus
aattgttatctaaagatgattct

SEQ ID NO: 2323 - DNA, 20 bp, Vaccinia Virus
aattaagcaactgacattga

SEQ ID NO: 2324 - DNA, 22 bp, Vaccinia Virus
atgcttatacaataaatatgaa

SEQ ID NO: 2325 - DNA, 18 bp, Vaccinia Virus
ttctatccaatttgtgaa

SEQ ID NO: 2326 - DNA, 18 bp, Vaccinia Virus
tctcttatttctcttttc

SEQ ID NO: 2327 - DNA, 24 bp, Vaccinia Virus
ttcccatagacacccagcccatag

SEQ ID NO: 2328 - DNA, 22 bp, Vaccinia Virus
atatttttgtcttacttttttt

SEQ ID NO: 2329 - DNA, 22 bp, Vaccinia Virus
aatgcccagtactgccatttga

SEQ ID NO: 2330 - DNA, 22 bp, Vaccinia Virus
tggaggtggtagatgccacaga

SEQ ID NO: 2331 - DNA, 24 bp, Vaccinia Virus
aatattatattttttctataaaaa

SEQ ID NO: 2332 - DNA, 22 bp, Vaccinia Virus
tatttttattcttgtgaccctc

SEQ ID NO: 2333 - DNA, 19 bp, Vaccinia Virus
tggcctggtgcctgtggaa

SEQ ID NO: 2334 - DNA, 18 bp, Vaccinia Virus
aatgttacttctaaaatt

SEQ ID NO: 2335 - DNA, 23 bp, Vaccinia Virus
aaataaaagcagaatgtatatca

SEQ ID NO: 2336 - DNA, 20 bp, Vaccinia Virus
agctgggtaataaatgtcta

SEQ ID NO: 2337 - DNA, 23 bp, Vaccinia Virus
atccagtaatccagtctccctca

SEQ ID NO: 2338 - DNA, 23 bp, Vaccinia Virus
ttccccagccagatggggtcaca

SEQ ID NO: 2339 - DNA, 20 bp, Vaccinia Virus
ccgctgacttgtgaatggga

SEQ ID NO: 2340 - DNA, 20 bp, Vaccinia Virus
taattcagtatagaatatgc

SEQ ID NO: 2341 - DNA, 23 bp, Vaccinia Virus
tatttctgattctccctctcttc

SEQ ID NO: 2342 - DNA, 22 bp, Vaccinia Virus
ggaaacgagtttgtacagaagt

SEQ ID NO: 2343 - DNA, 19 bp, Vaccinia Virus
agttgaatgacaaagcagt

SEQ ID NO: 2344 - DNA, 21 bp, Vaccinia Virus
agctagaaacagaaaacccat

SEQ ID NO: 2345 - DNA, 21 bp, Vaccinia Virus
tcagaagttccaaacagcaac

SEQ ID NO: 2346 - DNA, 19 bp, Vaccinia Virus
agtgagccaaaatcatgcc

SEQ ID NO: 2347 - DNA, 19 bp, Vaccinia Virus
ttttgttcttgtccctctc

SEQ ID NO: 2348 - DNA, 23 bp, Vaccinia Virus
agaacagggatttctatcaatgt

SEQ ID NO: 2349 - DNA, 24 bp, Vaccinia Virus
attctctaccactgctctttctca

SEQ ID NO: 2350 - DNA, 22 bp, Vaccinia Virus
aggatagtataaataaaaagaa

SEQ ID NO: 2351 - DNA, 16 bp, Vaccinia Virus
aagaattttctgtaca

SEQ ID NO: 2352 - DNA, 19 bp, Vaccinia Virus
gtgggaaaaaagcagaggc

SEQ ID NO: 2353 - DNA, 19 bp, Vaccinia Virus
agtcacagaactgggggtc

SEQ ID NO: 2354 - DNA, 21 bp, Vaccinia Virus
cggaagcagccctacaacaac

SEQ ID NO: 2355 - DNA, 20 bp, Vaccinia Virus
cctattttatttctccatca

SEQ ID NO: 2356 - DNA, 19 bp, Vaccinia Virus
aaaggcttactgataaact

SEQ ID NO: 2357 - DNA, 17 bp, Vaccinia Virus
aatggagatcaatttta

SEQ ID NO: 2358 - DNA, 17 bp, Vaccinia Virus
tctacctttgccacaag

SEQ ID NO: 2359 - DNA, 18 bp, Vaccinia Virus
ggaatttggaaacctcaa

SEQ ID NO: 2360 - DNA, 17 bp, Vaccinia Virus
ccgctacaaggacagtg

SEQ ID NO: 2361 - DNA, 22 bp, Vaccinia Virus
aaaggacaaataaagcaatgaa

SEQ ID NO: 2362 - DNA, 19 bp, Vaccinia Virus
cagttgggccggactctcc

SEQ ID NO: 2363 - DNA, 22 bp, Vaccinia Virus
aagtaaagatataattagagat

SEQ ID NO: 2364 - DNA, 18 bp, Vaccinia Virus
ttctggaagaatctacaa

SEQ ID NO: 2365 - DNA, 18 bp, Vaccinia Virus
agttgagaaactctcctg

SEQ ID NO: 2366 - DNA, 20 bp, Vaccinia Virus
atccaatacatatttttctc

SEQ ID NO: 2367 - DNA, 21 bp, Vaccinia Virus
aaagatactcacctgtacaaa

SEQ ID NO: 2368 - DNA, 19 bp, Vaccinia Virus
tatttttaattctctcttc

SEQ ID NO: 2369 - DNA, 15 bp, Vaccinia Virus
gaaaaggaatagtca

SEQ ID NO: 2370 - DNA, 19 bp, Vaccinia Virus
gatgtatggaaataaaggc

SEQ ID NO: 2371 - DNA, 20 bp, Vaccinia Virus
ttaccttgcagacggaatga

SEQ ID NO: 2372 - DNA, 20 bp, Vaccinia Virus
tgccaagaggcacccccttc

SEQ ID NO: 2373 - DNA, 16 bp, Vaccinia Virus
ttctgttagttactca

SEQ ID NO: 2374 - DNA, 19 bp, Vaccinia Virus
ataattaatagtatgttta

SEQ ID NO: 2375 - DNA, 18 bp, Vaccinia Virus
aaaggacaaggacatgag

SEQ ID NO: 2376 - DNA, 18 bp, Vaccinia Virus
tgtacagtcagtactata

SEQ ID NO: 2377 - DNA, 21 bp, Vaccinia Virus
atttcagggtttccaatcacc

SEQ ID NO: 2378 - DNA, 17 bp, Vaccinia Virus
taatgtttgttacagaa

SEQ ID NO: 2379 - DNA, 17 bp, Vaccinia Virus
tgatgttagaatcccac

SEQ ID NO: 2380 - DNA, 20 bp, Vaccinia Virus
aacctccttgttttagacac

SEQ ID NO: 2381 - DNA, 16 bp, Vaccinia Virus
agccacagaagatgtc

SEQ ID NO: 2382 - DNA, 23 bp, Vaccinia Virus
aaggatactgtcatttgcatttt

SEQ ID NO: 2383 - DNA, 22 bp, Vaccinia Virus
gagtttcttcttcaaggtctca

SEQ ID NO: 2384 - DNA, 18 bp, Vaccinia Virus
ctgaaagtagaactgaaa

SEQ ID NO: 2385 - DNA, 19 bp, Vaccinia Virus
tccccttcctagctccatg

SEQ ID NO: 2386 - DNA, 21 bp, Vaccinia Virus
agctcctaccttgggccctca

SEQ ID NO: 2387 - DNA, 23 bp, Vaccinia Virus
gtatattgaaccctaggctagtg

SEQ ID NO: 2388 - DNA, 18 bp, Vaccinia Virus
ttggaaatttttctatgg

SEQ ID NO: 2389 - DNA, 19 bp, Vaccinia Virus
agataaacacaaaatccat

SEQ ID NO: 2390 - DNA, 19 bp, Vaccinia Virus
agataaacacaaaatccat

SEQ ID NO: 2391 - DNA, 23 bp, Vaccinia Virus
aaaaaagctgtaatatgttatct

SEQ ID NO: 2392 - DNA, 21 bp, Vaccinia Virus
caatttcaaagagaacccaca

SEQ ID NO: 2393 - DNA, 19 bp, Vaccinia Virus
ttattctttcttcctcttc

SEQ ID NO: 2394 - DNA, 16 bp, Vaccinia Virus
tgtgagctttatcaga

SEQ ID NO: 2395 - DNA, 23 bp, Vaccinia Virus
atggactgaatcacatagattct

SEQ ID NO: 2396 - DNA, 20 bp, Vaccinia Virus
cagctccgaagaatcccccg

SEQ ID NO: 2397 - DNA, 17 bp, Vaccinia Virus
tgacggagtagcgagct

SEQ ID NO: 2398 - DNA, 21 bp, Vaccinia Virus
atgactgagaataagatccac

SEQ ID NO: 2399 - DNA, 18 bp, Vaccinia Virus
ccatgtaaatccgggtta

SEQ ID NO: 2400 - DNA, 19 bp, Vaccinia Virus
attgaaaggagagcaacgg

SEQ ID NO: 2401 - DNA, 19 bp, Vaccinia Virus
attgaaaggagagcaacgg

SEQ ID NO: 2402 - DNA, 19 bp, Vaccinia Virus
attgaaaggagagcaacgg

SEQ ID NO: 2403 - DNA, 19 bp, Vaccinia Virus
attgaaaggagagcaacgg

SEQ ID NO: 2404 - DNA, 19 bp, Vaccinia Virus
attgaaaggagagcaacgg

SEQ ID NO: 2405 - DNA, 19 bp, Vaccinia Virus
gaaaacttagtctgtggag

SEQ ID NO: 2406 - DNA, 19 bp, Vaccinia Virus
attgaaaggagagcaacgg

SEQ ID NO: 2407 - DNA, 19 bp, Vaccinia Virus
gaaaacttagtctgtggag

SEQ ID NO: 2408 - DNA, 16 bp, Vaccinia Virus
aatggccacctgatga

SEQ ID NO: 2409 - DNA, 17 bp, Vaccinia Virus
aaagttgggttgatagg

SEQ ID NO: 2410 - DNA, 18 bp, Vaccinia Virus
acctgcaactgtaatttg

SEQ ID NO: 2411 - DNA, 18 bp, Vaccinia Virus
acctgcaactgtaatttg

SEQ ID NO: 2412 - DNA, 18 bp, Vaccinia Virus
acctgcaactgtaatttg

SEQ ID NO: 2413 - DNA, 18 bp, Vaccinia Virus
acctgcaactgtaatttg

SEQ ID NO: 2414 - DNA, 18 bp, Vaccinia Virus
acctgcaactgtaatttg

SEQ ID NO: 2415 - DNA, 21 bp, Vaccinia Virus
aggcagaaaaacttgaaatac

SEQ ID NO: 2416 - DNA, 17 bp, Vaccinia Virus
ggcaaacatttttgtgg

SEQ ID NO: 2417 - DNA, 25 bp, Vaccinia Virus
atatttttgtaacaattgctttttt

SEQ ID NO: 2418 - DNA, 24 bp, Vaccinia Virus
gaaaaggttaaatcgtagaagcta

SEQ ID NO: 2419 - DNA, 20 bp, Vaccinia Virus
tgatgtcaatggagaactta

SEQ ID NO: 2420 - DNA, 17 bp, Vaccinia Virus
tgttgataaatccatca

SEQ ID NO: 2421 - DNA, 18 bp, Vaccinia Virus
acctaactgcaatgtgga

SEQ ID NO: 2422 - DNA, 18 bp, Vaccinia Virus
acctaactgcaatgtgga

SEQ ID NO: 2423 - DNA, 18 bp, Vaccinia Virus
acctaactgcaatgtgga

SEQ ID NO: 2424 - DNA, 18 bp, Vaccinia Virus
acctaactgcaatgtgga

SEQ ID NO: 2425 - DNA, 18 bp, Vaccinia Virus
acctaactgcaatgtgga

SEQ ID NO: 2426 - DNA, 19 bp, Vaccinia Virus
actgcacatattgcttttg

SEQ ID NO: 2427 - DNA, 18 bp, Vaccinia Virus
ggtcactttcccattaca

SEQ ID NO: 2428 - DNA, 18 bp, Vaccinia Virus
tatcagtttcaaataata

SEQ ID NO: 2429 - DNA, 16 bp, Vaccinia Virus
tcccccacctactcca

SEQ ID NO: 2430 - DNA, 20 bp, Vaccinia Virus
ttttgtaaaacttttttttc

SEQ ID NO: 2431 - DNA, 20 bp, Vaccinia Virus
atcacgtcagtaaaatacta

SEQ ID NO: 2432 - DNA, 22 bp, Vaccinia Virus
ttgccactcccccactccttct

SEQ ID NO: 2433 - DNA, 18 bp, Vaccinia Virus
atgactgagaacattaaa

SEQ ID NO: 2434 - DNA, 21 bp, Vaccinia Virus
aggacttttactaccatggta

SEQ ID NO: 2435 - DNA, 18 bp, Vaccinia Virus
cgcaggccctttacttca

SEQ ID NO: 2436 - DNA, 18 bp, Vaccinia Virus
gttttaatttaaactagt

SEQ ID NO: 2437 - DNA, 19 bp, Vaccinia Virus
atgctactctaataaatat

SEQ ID NO: 2438 - DNA, 19 bp, Vaccinia Virus
ccactgcatctcagaggaa

SEQ ID NO: 2439 - DNA, 18 bp, Vaccinia Virus
tgaggagacgttgagctc

SEQ ID NO: 2440 - DNA, 21 bp, Vaccinia Virus
gaaagttggaagtttgtacca

SEQ ID NO: 2441 - DNA, 17 bp, Vaccinia Virus
ctctgtggacctacaga

SEQ ID NO: 2442 - DNA, 18 bp, Vaccinia Virus
ggtaactgtggctaggga

SEQ ID NO: 2443 - DNA, 19 bp, Vaccinia Virus
agaatggagcagtttaata

SEQ ID NO: 2444 - DNA, 20 bp, Vaccinia Virus
ccgtgttggccttggctagg

SEQ ID NO: 2445 - DNA, 21 bp, Vaccinia Virus
ctcaacagctgcttattcccg

SEQ ID NO: 2446 - DNA, 18 bp, Vaccinia Virus
tgatagtgtctgcacaac

SEQ ID NO: 2447 - DNA, 23 bp, Vaccinia Virus
tgcctgacaattagctctattca

SEQ ID NO: 2448 - DNA, 21 bp, Vaccinia Virus
aggactttcccgtccacacac

SEQ ID NO: 2449 - DNA, 22 bp, Vaccinia Virus
tacactatagcactttgactaa

SEQ ID NO: 2450 - DNA, 24 bp, Vaccinia Virus
aatgcaagaaggaacacataagta

SEQ ID NO: 2451 - DNA, 21 bp, Vaccinia Virus
aaaaagtgtcaaaggaaatga

SEQ ID NO: 2452 - DNA, 18 bp, Vaccinia Virus
tattccctttttctcttc

SEQ ID NO: 2453 - DNA, 23 bp, Vaccinia Virus
aaaaggcaaaaccttaccttgga

SEQ ID NO: 2454 - DNA, 23 bp, Vaccinia Virus
aaaaggcaaaaccttaccttgga

SEQ ID NO: 2455 - DNA, 17 bp, Vaccinia Virus
agtcagtatctgtggaa

SEQ ID NO: 2456 - DNA, 20 bp, Vaccinia Virus
aaaggacaactgtagatgaa

SEQ ID NO: 2457 - DNA, 20 bp, Vaccinia Virus
aaataaaaacaagtatctca

SEQ ID NO: 2458 - DNA, 18 bp, Vaccinia Virus
aaatattagaactagaaa

SEQ ID NO: 2459 - DNA, 19 bp, Vaccinia Virus
ctgtctccccactcagtgg

SEQ ID NO: 2460 - DNA, 19 bp, Vaccinia Virus
ctgtctccccactcagtgg

SEQ ID NO: 2461 - DNA, 24 bp, Vaccinia Virus
ctttactgtgggaaaaccatctca

SEQ ID NO: 2462 - DNA, 20 bp, Vaccinia Virus
cagctccgaagaatcccccg

SEQ ID NO: 2463 - DNA, 21 bp, Vaccinia Virus
ccatcatctcatctctggatg

SEQ ID NO: 2464 - DNA, 17 bp, Vaccinia Virus
gcaggtgcttcaggata

SEQ ID NO: 2465 - DNA, 21 bp, Vaccinia Virus
gagaaagggcaaattatttta

SEQ ID NO: 2466 - DNA, 21 bp, Vaccinia Virus
gagaaagggcaaattatttta

SEQ ID NO: 2467 - DNA, 18 bp, Vaccinia Virus
gtggtcaaatatacatca

SEQ ID NO: 2468 - DNA, 18 bp, Vaccinia Virus
gtggtcaaatatacatca

SEQ ID NO: 2469 - DNA, 18 bp, Vaccinia Virus
gtggtcaaatatacatca

SEQ ID NO: 2470 - DNA, 19 bp, Vaccinia Virus
agatgttcagaatatctca

SEQ ID NO: 2471 - DNA, 24 bp, Vaccinia Virus
gatggttggcacaccatttctgta

SEQ ID NO: 2472 - DNA, 19 bp, Vaccinia Virus
gaatcattgggactaccca

SEQ ID NO: 2473 - DNA, 18 bp, Vaccinia Virus
gctaatgatgacatctca

SEQ ID NO: 2474 - DNA, 17 bp, Vaccinia Virus
ggatcatttgtattttg

SEQ ID NO: 2475 - DNA, 20 bp, Vaccinia Virus
aaaggacaactgtagatgaa

SEQ ID NO: 2476 - DNA, 22 bp, Vaccinia Virus
ggaaacaaatgtttctgacatt

SEQ ID NO: 2477 - DNA, 23 bp, Vaccinia Virus
aggactacgagaaagacaaagaa

SEQ ID NO: 2478 - DNA, 19 bp, Vaccinia Virus
ctaatgaaaataactccca

SEQ ID NO: 2479 - DNA, 23 bp, Vaccinia Virus
aaccattagaggtgcaatctaca

SEQ ID NO: 2480 - DNA, 22 bp, Vaccinia Virus
taagggaggtctgtgcatttta

SEQ ID NO: 2481 - DNA, 18 bp, Vaccinia Virus
tactacatgctttttgta

SEQ ID NO: 2482 - DNA, 25 bp, Vaccinia Virus
agagaaagtttgtaaaattccttac

SEQ ID NO: 2483 - DNA, 20 bp, Vaccinia Virus
ctccaaaacgctattccttc

SEQ ID NO: 2484 - DNA, 21 bp, Vaccinia Virus
aaaaggaaaccaggagtgcca

SEQ ID NO: 2485 - DNA, 20 bp, Vaccinia Virus
tattttacctgcctctcttc

SEQ ID NO: 2486 - DNA, 18 bp, Vaccinia Virus
tattcctgttttctcttt

SEQ ID NO: 2487 - DNA, 18 bp, Vaccinia Virus
aaacaaatgaaatcaaca

SEQ ID NO: 2488 - DNA, 22 bp, Vaccinia Virus
tcccattggtcaccttactcca

SEQ ID NO: 2489 - DNA, 22 bp, Vaccinia Virus
ttttgatgtgaaagatgttata

SEQ ID NO: 2490 - DNA, 19 bp, Vaccinia Virus
ccgctgattcctttcgtaa

SEQ ID NO: 2491 - DNA, 16 bp, Vaccinia Virus
ctctggtttcctcctc

SEQ ID NO: 2492 - DNA, 21 bp, Vaccinia Virus
acaaagcttgatgttttcact

SEQ ID NO: 2493 - DNA, 20 bp, Vaccinia Virus
gctggtatcgaggtgcccca

SEQ ID NO: 2494 - DNA, 20 bp, Vaccinia Virus
aagagtcatgctgtgatgaa

SEQ ID NO: 2495 - DNA, 22 bp, Vaccinia Virus
aatctataaagaactcaaacaa

SEQ ID NO: 2496 - DNA, 22 bp, Vaccinia Virus
aacctccgaaagctcagcacac

SEQ ID NO: 2497 - DNA, 22 bp, Vaccinia Virus
aatgcaaatcaaataaatatga

SEQ ID NO: 2498 - DNA, 19 bp, Vaccinia Virus
ataatggtaatgcaaatca

SEQ ID NO: 2499 - DNA, 25 bp, Vaccinia Virus
aagacttttttgaaaatatgcagaa

SEQ ID NO: 2500 - DNA, 18 bp, Vaccinia Virus
agtacatcattcctcctc

SEQ ID NO: 2501 - DNA, 20 bp, Vaccinia Virus
ctgacaaattaaggaggtta

SEQ ID NO: 2502 - DNA, 21 bp, Vaccinia Virus
acatggggagatcctacctct

SEQ ID NO: 2503 - DNA, 23 bp, Vaccinia Virus
aaagaaatgatgagacaaaaaga

SEQ ID NO: 2504 - DNA, 18 bp, Vaccinia Virus
tagcactgtagacacaac

SEQ ID NO: 2505 - DNA, 18 bp, Vaccinia Virus
ccaaaattgcaattcaga

SEQ ID NO: 2506 - DNA, 22 bp, Vaccinia Virus
gccacctgaaacataaaatgga

SEQ ID NO: 2507 - DNA, 17 bp, Vaccinia Virus
gatcatggaccacagaa

SEQ ID NO: 2508 - DNA, 22 bp, Vaccinia Virus
ccctaggctggttggtaaaaga

SEQ ID NO: 2509 - DNA, 20 bp, Vaccinia Virus
tttacatcatgagagatcaa

SEQ ID NO: 2510 - DNA, 15 bp, Vaccinia Virus
cctgatttgaattgg

SEQ ID NO: 2511 - DNA, 23 bp, Vaccinia Virus
tcccataatttctcccgcaatca

SEQ ID NO: 2512 - DNA, 17 bp, Vaccinia Virus
taatgtttggacttgga

SEQ ID NO: 2513 - DNA, 16 bp, Vaccinia Virus
aagtgttctgtattca

SEQ ID NO: 2514 - DNA, 21 bp, Vaccinia Virus
caaacaaccgactcctttcca

SEQ ID NO: 2515 - DNA, 18 bp, Vaccinia Virus
ccattccatggaaataaa

SEQ ID NO: 2516 - DNA, 19 bp, Vaccinia Virus
gatgttgcctcctctcctg

SEQ ID NO: 2517 - DNA, 17 bp, Vaccinia Virus
aggccaaaaatatctca

SEQ ID NO: 2518 - DNA, 20 bp, Vaccinia Virus
aaaagtgccttgcatcattt

SEQ ID NO: 2519 - DNA, 19 bp, Vaccinia Virus
aagaatcattaaaggaagc

SEQ ID NO: 2520 - DNA, 17 bp, Vaccinia Virus
agtataaaagcttctca

SEQ ID NO: 2521 - DNA, 17 bp, Vaccinia Virus
gagggtgtaataaactg

SEQ ID NO: 2522 - DNA, 21 bp, Vaccinia Virus
tgtactggattgcaccaagga

SEQ ID NO: 2523 - DNA, 18 bp, Vaccinia Virus
atatttactctttctgtc

SEQ ID NO: 2524 - DNA, 22 bp, Vaccinia Virus
tttgccaagaaaatctgggcct

SEQ ID NO: 2525 - DNA, 23 bp, Vaccinia Virus
aattaatgatgaggttacatgct

SEQ ID NO: 2526 - DNA, 18 bp, Vaccinia Virus
agaaactgttaaattgaa

SEQ ID NO: 2527 - DNA, 18 bp, Vaccinia Virus
agtcatttctccatcaca

SEQ ID NO: 2528 - DNA, 19 bp, Vaccinia Virus
tagtcattcgtggtaacta

SEQ ID NO: 2529 - DNA, 18 bp, Vaccinia Virus
tgctttctacattagtta

SEQ ID NO: 2530 - DNA, 19 bp, Vaccinia Virus
aggttggaaatgcactgaa

SEQ ID NO: 2531 - DNA, 17 bp, Vaccinia Virus
atgctactgaatttgga

SEQ ID NO: 2532 - DNA, 17 bp, Vaccinia Virus
aaatatacagaatggaa

SEQ ID NO: 2533 - DNA, 24 bp, Vaccinia Virus
ttgacatttgataaataaacatca

SEQ ID NO: 2534 - DNA, 19 bp, Vaccinia Virus
ctgttacttgcttcagtgg

SEQ ID NO: 2535 - DNA, 20 bp, Vaccinia Virus
aaaaagcagaggcccagtca

SEQ ID NO: 2536 - DNA, 20 bp, Vaccinia Virus
tcccctctaccaagggttcc

SEQ ID NO: 2537 - DNA, 18 bp, Vaccinia Virus
ctctgttttccccattca

SEQ ID NO: 2538 - DNA, 20 bp, Vaccinia Virus
ctagatgtagatgctgccta

SEQ ID NO: 2539 - DNA, 22 bp, Vaccinia Virus
ccaaacaggaagtggacattct

SEQ ID NO: 2540 - DNA, 15 bp, Vaccinia Virus
ctgataaaaagaggc

SEQ ID NO: 2541 - DNA, 18 bp, Vaccinia Virus
atatgctaaacaaaagaa

SEQ ID NO: 2542 - DNA, 21 bp, Vaccinia Virus
cattttattttaaaacgttga

SEQ ID NO: 2543 - DNA, 17 bp, Vaccinia Virus
acagcataataaaatcc

SEQ ID NO: 2544 - DNA, 21 bp, Vaccinia Virus
tccaccctttaaaagcattga

SEQ ID NO: 2545 - DNA, 18 bp, Vaccinia Virus
taacttcatgaagactta

SEQ ID NO: 2546 - DNA, 23 bp, Vaccinia Virus
acattaataaattctaagtttca

SEQ ID NO: 2547 - DNA, 25 bp, Vaccinia Virus
aatattttcactgttccttctttct

SEQ ID NO: 2548 - DNA, 16 bp, Vaccinia Virus
atgccaacaaagctta

SEQ ID NO: 2549 - DNA, 17 bp, Vaccinia Virus
ctagacaatttcttcta

SEQ ID NO: 2550 - DNA, 17 bp, Vaccinia Virus
ctgttgttaccccaagg

SEQ ID NO: 2551 - DNA, 18 bp, Vaccinia Virus
ctaatgaaaattattctc

SEQ ID NO: 2552 - DNA, 17 bp, Vaccinia Virus
cgtgttggttttgactg

SEQ ID NO: 2553 - DNA, 23 bp, Vaccinia Virus
agagtttgaaatcttcacatgaa

SEQ ID NO: 2554 - DNA, 20 bp, Vaccinia Virus
aggatattgaacacaaagaa

SEQ ID NO: 2555 - DNA, 19 bp, Vaccinia Virus
gtgactttaaggatttaga

SEQ ID NO: 2556 - DNA, 24 bp, Vaccinia Virus
agtatgcatacataaaagcaacca

SEQ ID NO: 2557 - DNA, 22 bp, Vaccinia Virus
tgtcttttaaagcatttactaa

SEQ ID NO: 2558 - DNA, 18 bp, Vaccinia Virus
gtgttatttcataaaatt

SEQ ID NO: 2559 - DNA, 23 bp, Vaccinia Virus
atgttctaactcctagactagtg

SEQ ID NO: 2560 - DNA, 16 bp, Vaccinia Virus
tagtcacagaaattcc

SEQ ID NO: 2561 - DNA, 19 bp, Vaccinia Virus
agtcattattgttgcagga

SEQ ID NO: 2562 - DNA, 16 bp, Vaccinia Virus
agtgaaggacctctca

SEQ ID NO: 2563 - DNA, 17 bp, Vaccinia Virus
ggataccacagccaatt

SEQ ID NO: 2564 - DNA, 20 bp, Vaccinia Virus
acaaagacattcttcccact

SEQ ID NO: 2565 - DNA, 19 bp, Vaccinia Virus
cacgaataaacaaacttaa

SEQ ID NO: 2566 - DNA, 24 bp, Vaccinia Virus
ttgacatttgataaataaacatca

SEQ ID NO: 2567 - DNA, 19 bp, Vaccinia Virus
tggtgagaaatccaacaaa

SEQ ID NO: 2568 - DNA, 18 bp, Vaccinia Virus
tcaaagctcccctataca

SEQ ID NO: 2569 - DNA, 20 bp, Vaccinia Virus
tattaagtaaaatccccttc

SEQ ID NO: 2570 - DNA, 22 bp, Vaccinia Virus
aaggccagggtaaaatgtctca

SEQ ID NO: 2571 - DNA, 21 bp, Vaccinia Virus
atttttatgctgttccctctt

SEQ ID NO: 2572 - DNA, 20 bp, Vaccinia Virus
tattttcttttcctctcttt

SEQ ID NO: 2573 - DNA, 16 bp, Vaccinia Virus
atgttacaactacttt

SEQ ID NO: 2574 - DNA, 18 bp, Vaccinia Virus
taatgtttgaaatacgaa

SEQ ID NO: 2575 - DNA, 17 bp, Vaccinia Virus
gaaagtaagtttgtagc

SEQ ID NO: 2576 - DNA, 21 bp, Vaccinia Virus
aaaggacaaagcctcagggaa

SEQ ID NO: 2577 - DNA, 21 bp, Vaccinia Virus
ttctcataaatgaaggtctgt

SEQ ID NO: 2578 - DNA, 21 bp, Vaccinia Virus
gggccccaaaagaccagaggc

SEQ ID NO: 2579 - DNA, 21 bp, Vaccinia Virus
tactacacacattgctatttg

SEQ ID NO: 2580 - DNA, 21 bp, Vaccinia Virus
tcagaacagatggatgtcaca

SEQ ID NO: 2581 - DNA, 18 bp, Vaccinia Virus
tgcacataaaaaataccg

SEQ ID NO: 2582 - DNA, 17 bp, Vaccinia Virus
agtcacagagatgagcc

SEQ ID NO: 2583 - DNA, 26 bp, Vaccinia Virus
atagctcccaaatgatgagtttgtca

SEQ ID NO: 2584 - DNA, 20 bp, Vaccinia Virus
tctaatgttatgtccactta

SEQ ID NO: 2585 - DNA, 16 bp, Vaccinia Virus
tgaaaatgctagtggg

SEQ ID NO: 2586 - DNA, 17 bp, Vaccinia Virus
actcagtgtggaaaaga

SEQ ID NO: 2587 - DNA, 19 bp, Vaccinia Virus
tcacaggaccgtcatgctg

SEQ ID NO: 2588 - DNA, 22 bp, Vaccinia Virus
atggacaatactattggtcgat

SEQ ID NO: 2589 - DNA, 17 bp, Vaccinia Virus
ttctatctaacacataa

SEQ ID NO: 2590 - DNA, 18 bp, Vaccinia Virus
ttctgttagaactcaggg

SEQ ID NO: 2591 - DNA, 23 bp, Vaccinia Virus
agcattgttaaagtctctcttca

SEQ ID NO: 2592 - DNA, 18 bp, Vaccinia Virus
tgcgtgcagattttgtac

SEQ ID NO: 2593 - DNA, 18 bp, Vaccinia Virus
agaaagagaaagaaatat

SEQ ID NO: 2594 - DNA, 19 bp, Vaccinia Virus
catcaaatcctgcccccgt

SEQ ID NO: 2595 - DNA, 22 bp, Vaccinia Virus
ccacccttcatactggccagag

SEQ ID NO: 2596 - DNA, 18 bp, Vaccinia Virus
tccagagcatttatctgc

SEQ ID NO: 2597 - DNA, 19 bp, Vaccinia Virus
atgttgaattttaaactag

SEQ ID NO: 2598 - DNA, 19 bp, Vaccinia Virus
tgtgtaaaactgccaagga

SEQ ID NO: 2599 - DNA, 19 bp, Vaccinia Virus
tttgtggcaaaaattttca

SEQ ID NO: 2600 - DNA, 17 bp, Vaccinia Virus
attattgacaacaccat

SEQ ID NO: 2601 - DNA, 22 bp, Vaccinia Virus
agaatggagcccactaatatta

SEQ ID NO: 2602 - DNA, 22 bp, Vaccinia Virus
gaaatcatacctgcagaagcta

SEQ ID NO: 2603 - DNA, 20 bp, Vaccinia Virus
tccttgtgttatttctaaaa

SEQ ID NO: 2604 - DNA, 21 bp, Vaccinia Virus
caaacaactgaaaaagctgca

SEQ ID NO: 2605 - DNA, 16 bp, Vaccinia Virus
atcctgagccatggtg

SEQ ID NO: 2606 - DNA, 19 bp, Vaccinia Virus
atttttaggttttctcttc

SEQ ID NO: 2607 - DNA, 21 bp, Vaccinia Virus
gactttatgaagatcccacac

SEQ ID NO: 2608 - DNA, 25 bp, Vaccinia Virus
ccaaaataataatgaaaataaaggc

SEQ ID NO: 2609 - DNA, 20 bp, Vaccinia Virus
ggctccctagcaactcccta

SEQ ID NO: 2610 - DNA, 19 bp, Vaccinia Virus
atatgtaaattatgcttta

SEQ ID NO: 2611 - DNA, 16 bp, Vaccinia Virus
gacagtggtaagtaaa

SEQ ID NO: 2612 - DNA, 17 bp, Vaccinia Virus
tattttttttctctgtc

SEQ ID NO: 2613 - DNA, 16 bp, Vaccinia Virus
tgcagcatgctataga

SEQ ID NO: 2614 - DNA, 17 bp, Vaccinia Virus
ggatatcacataatgcc

SEQ ID NO: 2615 - DNA, 22 bp, Vaccinia Virus
atggaatgatatatccaagttc

SEQ ID NO: 2616 - DNA, 18 bp, Vaccinia Virus
ccactgatttttcattgg

SEQ ID NO: 2617 - DNA, 22 bp, Vaccinia Virus
aaaggcagaggcatctttcgga

SEQ ID NO: 2618 - DNA, 23 bp, Vaccinia Virus
catcaatctggaaagaacttaca

SEQ ID NO: 2619 - DNA, 16 bp, Vaccinia Virus
ttggaaatcagtctgt

SEQ ID NO: 2620 - DNA, 21 bp, Vaccinia Virus
aatatccagaatctacaaaga

SEQ ID NO: 2621 - DNA, 17 bp, Vaccinia Virus
aatcttgctctgttccc

SEQ ID NO: 2622 - DNA, 18 bp, Vaccinia Virus
gcggacatcttttaagat

SEQ ID NO: 2623 - DNA, 25 bp, Vaccinia Virus
aactaaatatttataactgttctga

SEQ ID NO: 2624 - DNA, 23 bp, Vaccinia Virus
tattacagaaaatcccatattca

SEQ ID NO: 2625 - DNA, 23 bp, Vaccinia Virus
aatggccggctctgcaaatttat

SEQ ID NO: 2626 - DNA, 17 bp, Vaccinia Virus
agccccaggagcataca

SEQ ID NO: 2627 - DNA, 22 bp, Vaccinia Virus
tccttgagctttaaagcattga

SEQ ID NO: 2628 - DNA, 24 bp, Vaccinia Virus
atcacgggctaataatctttctca

SEQ ID NO: 2629 - DNA, 20 bp, Vaccinia Virus
aggatacatactacagagaa

SEQ ID NO: 2630 - DNA, 21 bp, Vaccinia Virus
atggaggtggacagagaataa

SEQ ID NO: 2631 - DNA, 21 bp, Vaccinia Virus
gtaagatgacagggctgactt

SEQ ID NO: 2632 - DNA, 18 bp, Vaccinia Virus
gagattccatactaaaga

SEQ ID NO: 2633 - DNA, 17 bp, Vaccinia Virus
ttctatccaacattcaa

SEQ ID NO: 2634 - DNA, 17 bp, Vaccinia Virus
tctacccatattacaga

SEQ ID NO: 2635 - DNA, 21 bp, Vaccinia Virus
aaaagacaaagttcgaattga

SEQ ID NO: 2636 - DNA, 16 bp, Vaccinia Virus
taagggaatgtatgta

SEQ ID NO: 2637 - DNA, 21 bp, Vaccinia Virus
cccacccttgctctccaatta

SEQ ID NO: 2638 - DNA, 17 bp, Vaccinia Virus
tctactaaaactacaaa

SEQ ID NO: 2639 - DNA, 21 bp, Vaccinia Virus
aaagtatttgttacataatca

SEQ ID NO: 2640 - DNA, 19 bp, Vaccinia Virus
cttacgtcagtaccacaaa

SEQ ID NO: 2641 - DNA, 20 bp, Vaccinia Virus
ctagatgaaaccatatctta

SEQ ID NO: 2642 - DNA, 22 bp, Vaccinia Virus
gccaatgaatttctgcttttca

SEQ ID NO: 2643 - DNA, 18 bp, Vaccinia Virus
gctgaaactgcaattgga

SEQ ID NO: 2644 - DNA, 18 bp, Vaccinia Virus
tcatatagggtgaaaagc

SEQ ID NO: 2645 - DNA, 20 bp, Vaccinia Virus
agaatatgctcaatacaaag

SEQ ID NO: 2646 - DNA, 18 bp, Vaccinia Virus
aggggagaggcacatttt

SEQ ID NO: 2647 - DNA, 25 bp, Vaccinia Virus
atggagaatgggctgaagcgatgct

SEQ ID NO: 2648 - DNA, 22 bp, Vaccinia Virus
cctgttccccacctcccggctc

SEQ ID NO: 2649 - DNA, 18 bp, Vaccinia Virus
gtgtttaataaatatgaa

SEQ ID NO: 2650 - DNA, 18 bp, Vaccinia Virus
tgatgccattgaagactt

SEQ ID NO: 2651 - DNA, 17 bp, Vaccinia Virus
aggcaccgcctccatcc

SEQ ID NO: 2652 - DNA, 19 bp, Vaccinia Virus
gtctactgggcgaaagcta

SEQ ID NO: 2653 - DNA, 22 bp, Vaccinia Virus
tggaaaggcaagtttgtaccca

SEQ ID NO: 2654 - DNA, 18 bp, Vaccinia Virus
agggaaaagttataacca

SEQ ID NO: 2655 - DNA, 20 bp, Vaccinia Virus
ccaggcaatatctcaggata

SEQ ID NO: 2656 - DNA, 20 bp, Vaccinia Virus
ccaccaactatttctggata

SEQ ID NO: 2657 - DNA, 18 bp, Vaccinia Virus
gagaataaaactatttta

SEQ ID NO: 2658 - DNA, 23 bp, Vaccinia Virus
tgaaaaaggaaagaaagtaacca

SEQ ID NO: 2659 - DNA, 18 bp, Vaccinia Virus
caggagatggaccccaga

SEQ ID NO: 2660 - DNA, 20 bp, Vaccinia Virus
agaacatgtattcatccaga

SEQ ID NO: 2661 - DNA, 19 bp, Vaccinia Virus
gcagaaaaaatacatttca

SEQ ID NO: 2662 - DNA, 20 bp, Vaccinia Virus
tccagatgatgctcctgcta

SEQ ID NO: 2663 - DNA, 21 bp, Vaccinia Virus
tctgaacacagatatcatcag

SEQ ID NO: 2664 - DNA, 18 bp, Vaccinia Virus
ttcatacatatatagata

SEQ ID NO: 2665 - DNA, 19 bp, Vaccinia Virus
agaaaaccgtccatttaga

SEQ ID NO: 2666 - DNA, 16 bp, Vaccinia Virus
agtcacagcagctgcc

SEQ ID NO: 2667 - DNA, 18 bp, Vaccinia Virus
ggaaaaaaatacaaagaa

SEQ ID NO: 2668 - DNA, 17 bp, Vaccinia Virus
aaagagagaaacggaca

SEQ ID NO: 2669 - DNA, 20 bp, Vaccinia Virus
gtctagagcaccacaccgct

SEQ ID NO: 2670 - DNA, 23 bp, Vaccinia Virus
tcctaccagaactcctccgatca

SEQ ID NO: 2671 - DNA, 16 bp, Vaccinia Virus
atctctgcttcacagt

SEQ ID NO: 2672 - DNA, 16 bp, Vaccinia Virus
ttgccaagaggtctcc

SEQ ID NO: 2673 - DNA, 19 bp, Vaccinia Virus
cagtggtccagacttgcca

SEQ ID NO: 2674 - DNA, 23 bp, Vaccinia Virus
atgaaggtgtgtcccagatatta

SEQ ID NO: 2675 - DNA, 17 bp, Vaccinia Virus
aaaaaaaggggaaatgg

SEQ ID NO: 2676 - DNA, 21 bp, Vaccinia Virus
aaaaattgggatatgttatct

SEQ ID NO: 2677 - DNA, 19 bp, Vaccinia Virus
agtgagccgagaccatacc

SEQ ID NO: 2678 - DNA, 17 bp, Vaccinia Virus
atatgccaaaattgaga

SEQ ID NO: 2679 - DNA, 20 bp, Vaccinia Virus
agtatgttatacaaatgcca

SEQ ID NO: 2680 - DNA, 21 bp, Vaccinia Virus
tatctctgttttggtaccagt

SEQ ID NO: 2681 - DNA, 18 bp, Vaccinia Virus
tagactgtctctgtggaa

SEQ ID NO: 2682 - DNA, 19 bp, Vaccinia Virus
tgattgcattggaagatca

SEQ ID NO: 2683 - DNA, 18 bp, Vaccinia Virus
ttctacttccaccacaag

SEQ ID NO: 2684 - DNA, 21 bp, Vaccinia Virus
ctcagtgaaaacatcaattca

SEQ ID NO: 2685 - DNA, 20 bp, Vaccinia Virus
tagagaagggaaagacttta

SEQ ID NO: 2686 - DNA, 18 bp, Vaccinia Virus
tgtattttaaaatattga

SEQ ID NO: 2687 - DNA, 20 bp, Vaccinia Virus
attaaatccaggaacatata

SEQ ID NO: 2688 - DNA, 18 bp, Vaccinia Virus
tgctattaaatagtaaac

SEQ ID NO: 2689 - DNA, 20 bp, Vaccinia Virus
gtatgttttacttaaactag

SEQ ID NO: 2690 - DNA, 18 bp, Vaccinia Virus
atgggtaccccagagaag

SEQ ID NO: 2691 - DNA, 19 bp, Vaccinia Virus
ttctcatgggtaccccaga

SEQ ID NO: 2692 - DNA, 20 bp, Vaccinia Virus
aataatattttttttgtttt

SEQ ID NO: 2693 - DNA, 19 bp, Vaccinia Virus
tccagagcctctgtcctgc

SEQ ID NO: 2694 - DNA, 18 bp, Vaccinia Virus
ttctgttgcccaagctgg

SEQ ID NO: 2695 - DNA, 19 bp, Vaccinia Virus
aagcctaaaatatatttta

SEQ ID NO: 2696 - DNA, 19 bp, Vaccinia Virus
aggcaggtttgctacacag

SEQ ID NO: 2697 - DNA, 21 bp, Vaccinia Virus
agaatggagtgtaccaaatta

SEQ ID NO: 2698 - DNA, 16 bp, Vaccinia Virus
ctccttcatctactcc

SEQ ID NO: 2699 - DNA, 19 bp, Vaccinia Virus
accatgaactcgtactatg

SEQ ID NO: 2700 - DNA, 22 bp, Vaccinia Virus
cctgttccccacctcccggctc

SEQ ID NO: 2701 - DNA, 18 bp, Vaccinia Virus
agtcacagaaatcattct

SEQ ID NO: 2702 - DNA, 15 bp, Vaccinia Virus
caatgagagattata

SEQ ID NO: 2703 - DNA, 18 bp, Vaccinia Virus
aacaaattgtggatcatg

SEQ ID NO: 2704 - DNA, 20 bp, Vaccinia Virus
agaatatgtcacataaagaa

SEQ ID NO: 2705 - DNA, 19 bp, Vaccinia Virus
aattgttgcctagtcctgc

SEQ ID NO: 2706 - DNA, 21 bp, Vaccinia Virus
ataaaattaggtgacaagggt

SEQ ID NO: 2707 - DNA, 22 bp, Vaccinia Virus
tatctctaagttatactaatta

SEQ ID NO: 2708 - DNA, 20 bp, Vaccinia Virus
attctctgacctttctctct

SEQ ID NO: 2709 - DNA, 19 bp, Vaccinia Virus
cctgtttcccaccttctct

SEQ ID NO: 2710 - DNA, 19 bp, Vaccinia Virus
atgttgaatgtatctagtg

SEQ ID NO: 2711 - DNA, 18 bp, Vaccinia Virus
ttttattttcctgtcttc

SEQ ID NO: 2712 - DNA, 17 bp, Vaccinia Virus
cggaacacaccctctca

SEQ ID NO: 2713 - DNA, 20 bp, Vaccinia Virus
caggaatgtacactttacat

SEQ ID NO: 2714 - DNA, 19 bp, Vaccinia Virus
tgcaaagaaggtttccaga

SEQ ID NO: 2715 - DNA, 19 bp, Vaccinia Virus
attgaaagaggtgtgctgg

SEQ ID NO: 2716 - DNA, 18 bp, Vaccinia Virus
tgatttttataccaaaga

SEQ ID NO: 2717 - DNA, 22 bp, Vaccinia Virus
atttttttttctctctcttttc

SEQ ID NO: 2718 - DNA, 22 bp, Vaccinia Virus
ttggaaataaagaagtgctctg

SEQ ID NO: 2719 - DNA, 18 bp, Vaccinia Virus
gtcatatgaatgttgagc

SEQ ID NO: 2720 - DNA, 17 bp, Vaccinia Virus
tataggttaggaacaaa

SEQ ID NO: 2721 - DNA, 17 bp, Vaccinia Virus
tacagctgagcaatgca

SEQ ID NO: 2722 - DNA, 21 bp, Vaccinia Virus
taccttgatgcaaatttgcca

SEQ ID NO: 2723 - DNA, 18 bp, Vaccinia Virus
tattttttgctttctctc

SEQ ID NO: 2724 - DNA, 20 bp, Vaccinia Virus
tggcagcagtgctctgggaa

SEQ ID NO: 2725 - DNA, 18 bp, Vaccinia Virus
gaaatcagtgttgtggag

SEQ ID NO: 2726 - DNA, 19 bp, Vaccinia Virus
tttgcacatcagcatttta

SEQ ID NO: 2727 - DNA, 18 bp, Vaccinia Virus
agacagaaatgttacttc

SEQ ID NO: 2728 - DNA, 17 bp, Vaccinia Virus
gtcatgggaggaagcta

SEQ ID NO: 2729 - DNA, 22 bp, Vaccinia Virus
cagatgtggccatccctccctg

SEQ ID NO: 2730 - DNA, 18 bp, Vaccinia Virus
cccacttccttccagtca

SEQ ID NO: 2731 - DNA, 18 bp, Vaccinia Virus
aagataagctattattaa

SEQ ID NO: 2732 - DNA, 21 bp, Vaccinia Virus
tgatgcttcattgaagactta

SEQ ID NO: 2733 - DNA, 19 bp, Vaccinia Virus
agtgagccgagaccatgcc

SEQ ID NO: 2734 - DNA, 18 bp, Vaccinia Virus
ggtcaaaagtttgagcca

SEQ ID NO: 2735 - DNA, 24 bp, Vaccinia Virus
cagcttttggtaatattcttcctc

SEQ ID NO: 2736 - DNA, 24 bp, Vaccinia Virus
cgacagaataaggtacaaatgtag

SEQ ID NO: 2737 - DNA, 21 bp, Vaccinia Virus
atgaagtcttttaacagtctc

SEQ ID NO: 2738 - DNA, 18 bp, Vaccinia Virus
tccatgctgtagatacca

SEQ ID NO: 2739 - DNA, 17 bp, Vaccinia Virus
ttaggaattaaattctc

SEQ ID NO: 2740 - DNA, 19 bp, Vaccinia Virus
aacagcataaaggacccca

SEQ ID NO: 2741 - DNA, 21 bp, Vaccinia Virus
cctaccttatttctccagcca

SEQ ID NO: 2742 - DNA, 20 bp, Vaccinia Virus
caaaatgtaccttattccca

SEQ ID NO: 2743 - DNA, 22 bp, Vaccinia Virus
tatttttattttctccctgctc

SEQ ID NO: 2744 - DNA, 19 bp, Vaccinia Virus
ccagacaagtgcccaacga

SEQ ID NO: 2745 - DNA, 17 bp, Vaccinia Virus
caacaaaaaggagctat

SEQ ID NO: 2746 - DNA, 19 bp, Vaccinia Virus
tagtcacaagatttaccat

SEQ ID NO: 2747 - DNA, 18 bp, Vaccinia Virus
aactaaactactaagtta

SEQ ID NO: 2748 - DNA, 17 bp, Vaccinia Virus
gatgtcgaagaaactta

SEQ ID NO: 2749 - DNA, 16 bp, Vaccinia Virus
tccattttaaaacatt

SEQ ID NO: 2750 - DNA, 24 bp, Vaccinia Virus
caaggacaaggagaatgaattcaa

SEQ ID NO: 2751 - DNA, 21 bp, Vaccinia Virus
gacaaagttctgtttcttcac

SEQ ID NO: 2752 - DNA, 18 bp, Vaccinia Virus
caggacgtcctctacaca

SEQ ID NO: 2753 - DNA, 19 bp, Vaccinia Virus
ctctgagaagagtgtcaca

SEQ ID NO: 2754 - DNA, 23 bp, Vaccinia Virus
gcgactcggggcactgctcctca

SEQ ID NO: 2755 - DNA, 19 bp, Vaccinia Virus
gagtccttcggtggcctca

SEQ ID NO: 2756 - DNA, 15 bp, Vaccinia Virus
tgggacagccgactt

SEQ ID NO: 2757 - DNA, 18 bp, Vaccinia Virus
aattaaaaatccaacaaa

SEQ ID NO: 2758 - DNA, 19 bp, Vaccinia Virus
gcattatttggaagactta

SEQ ID NO: 2759 - DNA, 22 bp, Vaccinia Virus
atggatgaagatgatgaccgat

SEQ ID NO: 2760 - DNA, 21 bp, Vaccinia Virus
gaaagtattcctatcatgtat

SEQ ID NO: 2761 - DNA, 23 bp, Vaccinia Virus
tattaatgtttaaatcccatctc

SEQ ID NO: 2762 - DNA, 17 bp, Vaccinia Virus
gaaatatgcaggtatat

SEQ ID NO: 2763 - DNA, 18 bp, Vaccinia Virus
tggaaactagaagactta

SEQ ID NO: 2764 - DNA, 16 bp, Vaccinia Virus
agtcacaaacaatgtc

SEQ ID NO: 2765 - DNA, 21 bp, Vaccinia Virus
aaacaaaacatctcaggacat

SEQ ID NO: 2766 - DNA, 17 bp, Vaccinia Virus
attggtaaacaaccaat

SEQ ID NO: 2767 - DNA, 17 bp, Vaccinia Virus
cccctcctctctccatg

SEQ ID NO: 2768 - DNA, 19 bp, Vaccinia Virus
tttccagaagggtctccaa

SEQ ID NO: 2769 - DNA, 19 bp, Vaccinia Virus
ataccagaggtcacttcag

SEQ ID NO: 2770 - DNA, 20 bp, Vaccinia Virus
cagctggaagacattcctcc

SEQ ID NO: 2771 - DNA, 18 bp, Vaccinia Virus
tgaaaaaaaccagagact

SEQ ID NO: 2772 - DNA, 17 bp, Vaccinia Virus
aggcagaaggatcactt

SEQ ID NO: 2773 - DNA, 19 bp, Vaccinia Virus
ttttattctctctcccttt

SEQ ID NO: 2774 - DNA, 19 bp, Vaccinia Virus
ttttattctctctcccttt

SEQ ID NO: 2775 - DNA, 19 bp, Vaccinia Virus
atattacaaatattttgag

SEQ ID NO: 2776 - DNA, 23 bp, Vaccinia Virus
ttaatgtattatatacactgata

SEQ ID NO: 2777 - DNA, 20 bp, Vaccinia Virus
aagtcaaataaaacaggaca

SEQ ID NO: 2778 - DNA, 18 bp, Vaccinia Virus
aatcaatacaatatatgc

SEQ ID NO: 2779 - DNA, 16 bp, Vaccinia Virus
gacactctagatgaaa

SEQ ID NO: 2780 - DNA, 22 bp, Vaccinia Virus
taacattatgtgattctaaatg

SEQ ID NO: 2781 - DNA, 23 bp, Vaccinia Virus
tgtccctgccctagaaacattga

SEQ ID NO: 2782 - DNA, 20 bp, Vaccinia Virus
ctagagcacaagtcctgcta

SEQ ID NO: 2783 - DNA, 20 bp, Vaccinia Virus
acaaaacaactctgagatga

SEQ ID NO: 2784 - DNA, 19 bp, Vaccinia Virus
tatatttttaaaacattga

SEQ ID NO: 2785 - DNA, 23 bp, Vaccinia Virus
acgttttacaatcaatttgtaca

SEQ ID NO: 2786 - DNA, 21 bp, Vaccinia Virus
tgtctgaaagcaaccctactc

SEQ ID NO: 2787 - DNA, 25 bp, Vaccinia Virus
tgtcccacaatgcctaaaacattga

SEQ ID NO: 2788 - DNA, 21 bp, Vaccinia Virus
ggtggcggaggcccccagctc

SEQ ID NO: 2789 - DNA, 21 bp, Vaccinia Virus
ttggaaaaaccctctgtggag

SEQ ID NO: 2790 - DNA, 20 bp, Vaccinia Virus
cagccccggcccattcctcc

SEQ ID NO: 2791 - DNA, 17 bp, Vaccinia Virus
aaatgataatgatactg

SEQ ID NO: 2792 - DNA, 18 bp, Vaccinia Virus
tgtacagtcagttctata

SEQ ID NO: 2793 - DNA, 18 bp, Vaccinia Virus
caaggccatcacaaagca

SEQ ID NO: 2794 - DNA, 17 bp, Vaccinia Virus
ttctgccccaccacaaa

SEQ ID NO: 2795 - DNA, 23 bp, Vaccinia Virus
aaaagagttgtaaattaaagatg

SEQ ID NO: 2796 - DNA, 20 bp, Vaccinia Virus
ttcccctttttcctacccca

SEQ ID NO: 2797 - DNA, 18 bp, Vaccinia Virus
tttcaaaaagaggttaca

SEQ ID NO: 2798 - DNA, 18 bp, Vaccinia Virus
ctaaacaatttgcattta

SEQ ID NO: 2799 - DNA, 18 bp, Vaccinia Virus
gtatgttgaaataaacta

SEQ ID NO: 2800 - DNA, 17 bp, Vaccinia Virus
gatttctggaagactta

SEQ ID NO: 2801 - DNA, 28 bp, Vaccinia Virus
aaagaaacatcatcttcagataataaga

SEQ ID NO: 2802 - DNA, 18 bp, Vaccinia Virus
gctgataaagaagtgcta

SEQ ID NO: 2803 - DNA, 18 bp, Vaccinia Virus
cggacatttatttgcatc

SEQ ID NO: 2804 - DNA, 19 bp, Vaccinia Virus
gtccaactatttattgcca

SEQ ID NO: 2805 - DNA, 19 bp, Vaccinia Virus
ttgaaaagaccacaaccaa

SEQ ID NO: 2806 - DNA, 19 bp, Vaccinia Virus
ttacctgggctattgggga

SEQ ID NO: 2807 - DNA, 18 bp, Vaccinia Virus
ttttttccctttctctct

SEQ ID NO: 2808 - DNA, 18 bp, Vaccinia Virus
ttttttccctttctctct

SEQ ID NO: 2809 - DNA, 18 bp, Vaccinia Virus
actaagaaaactatttca

SEQ ID NO: 2810 - DNA, 18 bp, Vaccinia Virus
tctggtggagggccatgg

SEQ ID NO: 2811 - DNA, 26 bp, Vaccinia Virus
attggaaattgttgctgtgttctgtg

SEQ ID NO: 2812 - DNA, 17 bp, Vaccinia Virus
gactttccccattttag

SEQ ID NO: 2813 - DNA, 18 bp, Vaccinia Virus
ccagtatttatctctgga

SEQ ID NO: 2814 - DNA, 18 bp, Vaccinia Virus
tattttcaccctcttttc

SEQ ID NO: 2815 - DNA, 24 bp, Vaccinia Virus
gccacaggttcatatccagaggaa

SEQ ID NO: 2816 - DNA, 16 bp, Vaccinia Virus
ggaggcgcctgtggaa

SEQ ID NO: 2817 - DNA, 18 bp, Vaccinia Virus
attcctcttcctctcttc

SEQ ID NO: 2818 - DNA, 17 bp, Vaccinia Virus
tggtagtgctcctggaa

SEQ ID NO: 2819 - DNA, 21 bp, Vaccinia Virus
tgtacaattagtactttatag

SEQ ID NO: 2820 - DNA, 17 bp, Vaccinia Virus
aaaatggtacctctttc

SEQ ID NO: 2821 - DNA, 21 bp, Vaccinia Virus
tagagtattcagactttgata

SEQ ID NO: 2822 - DNA, 20 bp, Vaccinia Virus
aagaaccattaggagtggaa

SEQ ID NO: 2823 - DNA, 23 bp, Vaccinia Virus
atgaccctaaagttagtgtggtg

SEQ ID NO: 2824 - DNA, 19 bp, Vaccinia Virus
agccatatgtagtcattga

SEQ ID NO: 2825 - DNA, 22 bp, Vaccinia Virus
taattccacagtcagaacatgc

SEQ ID NO: 2826 - DNA, 19 bp, Vaccinia Virus
aaagtaaatacaatttcaa

SEQ ID NO: 2827 - DNA, 19 bp, Vaccinia Virus
ttttggtggctcgatgtta

SEQ ID NO: 2828 - DNA, 22 bp, Vaccinia Virus
ggtgacagagtgagtgagactc

SEQ ID NO: 2829 - DNA, 21 bp, Vaccinia Virus
atttttataagaaaattttac

SEQ ID NO: 2830 - DNA, 28 bp, Vaccinia Virus
ttgtgtgaaagatgtttcataccaagga

SEQ ID NO: 2831 - DNA, 22 bp, Vaccinia Virus
agccagacaaaaagaatgattc

SEQ ID NO: 2832 - DNA, 20 bp, Vaccinia Virus
aaaaagtacacagaaatatt

SEQ ID NO: 2833 - DNA, 20 bp, Vaccinia Virus
aacaaattgcataggagtgt

SEQ ID NO: 2834 - DNA, 24 bp, Vaccinia Virus
aaccaccagccgttcctgatctca

SEQ ID NO: 2835 - DNA, 22 bp, Vaccinia Virus
atggaatgtggtacaaattgtt

SEQ ID NO: 2836 - DNA, 17 bp, Vaccinia Virus
gtctttctacatagtta

SEQ ID NO: 2837 - DNA, 21 bp, Vaccinia Virus
cagccaggccctcttctcctg

SEQ ID NO: 2838 - DNA, 15 bp, Vaccinia Virus
agcacaaaccatgtc

SEQ ID NO: 2839 - DNA, 16 bp, Vaccinia Virus
cctgtttcccacctcc

SEQ ID NO: 2840 - DNA, 21 bp, Vaccinia Virus
gtcatttagaagtggaagcta

SEQ ID NO: 2841 - DNA, 23 bp, Vaccinia Virus
ttctgttgttcaccattaagggg

SEQ ID NO: 2842 - DNA, 17 bp, Vaccinia Virus
ggaacagctctgtggaa

SEQ ID NO: 2843 - DNA, 20 bp, Vaccinia Virus
atgaagattgttcagatact

SEQ ID NO: 2844 - DNA, 22 bp, Vaccinia Virus
gacaaagtttaacaccttcact

SEQ ID NO: 2845 - DNA, 24 bp, Vaccinia Virus
gatagggtttcatttatttctata

SEQ ID NO: 2846 - DNA, 20 bp, Vaccinia Virus
tctaagctatgcccatttat

SEQ ID NO: 2847 - DNA, 18 bp, Vaccinia Virus
aaaggaaaattctagcca

SEQ ID NO: 2848 - DNA, 22 bp, Vaccinia Virus
ttctgttacacatgtctactta

SEQ ID NO: 2849 - DNA, 19 bp, Vaccinia Virus
acagggccagcttgccata

SEQ ID NO: 2850 - DNA, 19 bp, Vaccinia Virus
gcttcagttataaatagta

SEQ ID NO: 2851 - DNA, 17 bp, Vaccinia Virus
agcccctggtcagtctg

SEQ ID NO: 2852 - DNA, 21 bp, Vaccinia Virus
aggtgcttatatcccaccaac

SEQ ID NO: 2853 - DNA, 23 bp, Vaccinia Virus
atggaaggggaaatatgatagat

SEQ ID NO: 2854 - DNA, 19 bp, Vaccinia Virus
aaggatttaaaatatattc

SEQ ID NO: 2855 - DNA, 22 bp, Vaccinia Virus
ttccagtgaaacagatgttaca

SEQ ID NO: 2856 - DNA, 22 bp, Vaccinia Virus
tattgaaagaagagaggtgggg

SEQ ID NO: 2857 - DNA, 19 bp, Vaccinia Virus
ctcaggatggaccctcaga

SEQ ID NO: 2858 - DNA, 18 bp, Vaccinia Virus
atggagtctccctctgtc

SEQ ID NO: 2859 - DNA, 21 bp, Vaccinia Virus
acaaatgggtattcttttcat

SEQ ID NO: 2860 - DNA, 19 bp, Vaccinia Virus
tctctcactacctttctca

SEQ ID NO: 2861 - DNA, 22 bp, Vaccinia Virus
aaggaacgcttcccgggacaat

SEQ ID NO: 2862 - DNA, 21 bp, Vaccinia Virus
ggaaacaaaacaaaacaaaac

SEQ ID NO: 2863 - DNA, 21 bp, Vaccinia Virus
ataaagttacacaaaggtagt

SEQ ID NO: 2864 - DNA, 17 bp, Vaccinia Virus
tgacaactggaagactt

SEQ ID NO: 2865 - DNA, 21 bp, Vaccinia Virus
aatacaggagatagaaccaga

SEQ ID NO: 2866 - DNA, 18 bp, Vaccinia Virus
tttgcttctctttctcct

SEQ ID NO: 2867 - DNA, 24 bp, Vaccinia Virus
ggaaacacactcctgcagaagctg

SEQ ID NO: 2868 - DNA, 17 bp, Vaccinia Virus
gcagtacagtactatta

SEQ ID NO: 2869 - DNA, 22 bp, Vaccinia Virus
accgcaggctatgctctttgta

SEQ ID NO: 2870 - DNA, 16 bp, Vaccinia Virus
ttctggccaccacaga

SEQ ID NO: 2871 - DNA, 21 bp, Vaccinia Virus
gaaaaggaaaaggaataatca

SEQ ID NO: 2872 - DNA, 19 bp, Vaccinia Virus
tagtcaagtcaccatgctg

SEQ ID NO: 2873 - DNA, 22 bp, Vaccinia Virus
atttttagcctcttttctcttc

SEQ ID NO: 2874 - DNA, 24 bp, Vaccinia Virus
acaaaacaatgctgaagttaatat

SEQ ID NO: 2875 - DNA, 21 bp, Vaccinia Virus
gatggaaaactgaaatttgga

SEQ ID NO: 2876 - DNA, 18 bp, Vaccinia Virus
tcacagaaagtaaagccg

SEQ ID NO: 2877 - DNA, 18 bp, Vaccinia Virus
aggactccctatcccaca

SEQ ID NO: 2878 - DNA, 19 bp, Vaccinia Virus
ttttaaaatctattctctc

SEQ ID NO: 2879 - DNA, 19 bp, Vaccinia Virus
ggaaacgcgctctgtagaa

SEQ ID NO: 2880 - DNA, 19 bp, Vaccinia Virus
cggaagcagtcgctgcaac

SEQ ID NO: 2881 - DNA, 23 bp, Vaccinia Virus
gttctgctatttccaatcagtca

SEQ ID NO: 2882 - DNA, 16 bp, Vaccinia Virus
gatgccaccagactta

SEQ ID NO: 2883 - DNA, 19 bp, Vaccinia Virus
tggcataagctgaatccca

SEQ ID NO: 2884 - DNA, 19 bp, Vaccinia Virus
aggcctcaaaacaatgaaa

SEQ ID NO: 2885 - DNA, 20 bp, Vaccinia Virus
tatttttatgcctctgtctc

SEQ ID NO: 2886 - DNA, 22 bp, Vaccinia Virus
ccaaggtctcacactcctcctg

SEQ ID NO: 2887 - DNA, 20 bp, Vaccinia Virus
ttctgttgtgtctcatacag

SEQ ID NO: 2888 - DNA, 22 bp, Vaccinia Virus
cttgataatagtcttattccca

SEQ ID NO: 2889 - DNA, 18 bp, Vaccinia Virus
actcacataggtgaaaaa

SEQ ID NO: 2890 - DNA, 20 bp, Vaccinia Virus
tattctcattacttctcttt

SEQ ID NO: 2891 - DNA, 21 bp, Vaccinia Virus
actgcctactgcatcgagtca

SEQ ID NO: 2892 - DNA, 18 bp, Vaccinia Virus
gcggcagctactactgcc

SEQ ID NO: 2893 - DNA, 18 bp, Vaccinia Virus
gaaataaaagcagcatca

SEQ ID NO: 2894 - DNA, 21 bp, Vaccinia Virus
aagtgtttgattcagagatgt

SEQ ID NO: 2895 - DNA, 19 bp, Vaccinia Virus
accgacgtcaaaaagtctg

SEQ ID NO: 2896 - DNA, 19 bp, Vaccinia Virus
ccatatgaattttggtata

SEQ ID NO: 2897 - DNA, 23 bp, Vaccinia Virus
ttctatttaaaaatagccacaaa

SEQ ID NO: 2898 - DNA, 18 bp, Vaccinia Virus
acagtaatttttgccatg

SEQ ID NO: 2899 - DNA, 24 bp, Vaccinia Virus
ttgacaatggtaataataaaatgg

SEQ ID NO: 2900 - DNA, 21 bp, Vaccinia Virus
ctgaggcagaagaatcacttc

SEQ ID NO: 2901 - DNA, 20 bp, Vaccinia Virus
gaggcagaagaatcacttca

SEQ ID NO: 2902 - DNA, 20 bp, Vaccinia Virus
ccgccctcacccctccaatc

SEQ ID NO: 2903 - DNA, 18 bp, Vaccinia Virus
aaatattaacaggtatat

SEQ ID NO: 2904 - DNA, 19 bp, Vaccinia Virus
cactgtaatgttacatgca

SEQ ID NO: 2905 - DNA, 22 bp, Vaccinia Virus
tgaagtaattgtgctgtattta

SEQ ID NO: 2906 - DNA, 19 bp, Vaccinia Virus
aaaaggcagaacagttttg

SEQ ID NO: 2907 - DNA, 17 bp, Vaccinia Virus
tctactaaaactacaaa

SEQ ID NO: 2908 - DNA, 24 bp, Vaccinia Virus
aatgagtctattaataaatatgaa

SEQ ID NO: 2909 - DNA, 19 bp, Vaccinia Virus
caacaaaggattttattcc

SEQ ID NO: 2910 - DNA, 22 bp, Vaccinia Virus
gccatgatggaaacagatagtg

SEQ ID NO: 2911 - DNA, 21 bp, Vaccinia Virus
aatgttaattatgaaacacct

SEQ ID NO: 2912 - DNA, 17 bp, Vaccinia Virus
taatgttgagatacgaa

SEQ ID NO: 2913 - DNA, 24 bp, Vaccinia Virus
taaggaaatatttatttgtatttt

SEQ ID NO: 2914 - DNA, 19 bp, Vaccinia Virus
aacatcatgattattgatg

SEQ ID NO: 2915 - DNA, 17 bp, Vaccinia Virus
ttcatgtaacccataga

SEQ ID NO: 2916 - DNA, 23 bp, Vaccinia Virus
gaaataaaaattatttgtataat

SEQ ID NO: 2917 - DNA, 19 bp, Vaccinia Virus
gtatgtgctgttaaactag

SEQ ID NO: 2918 - DNA, 21 bp, Vaccinia Virus
acttactgaaattcccagtca

SEQ ID NO: 2919 - DNA, 19 bp, Vaccinia Virus
acaaaaagactaaacctct

SEQ ID NO: 2920 - DNA, 24 bp, Vaccinia Virus
agaaaactaacacccagaaaggag

SEQ ID NO: 2921 - DNA, 24 bp, Vaccinia Virus
aatatttttattcttgagttatct

SEQ ID NO: 2922 - DNA, 19 bp, Vaccinia Virus
cttcagatcctgtctgtca

SEQ ID NO: 2923 - DNA, 18 bp, Vaccinia Virus
agccccggttcctccccg

SEQ ID NO: 2924 - DNA, 16 bp, Vaccinia Virus
ggctgaaatggtcaat

SEQ ID NO: 2925 - DNA, 20 bp, Vaccinia Virus
gaaacaaatgatgaaaacat

SEQ ID NO: 2926 - DNA, 19 bp, Vaccinia Virus
ctcatcctgtacctataga

SEQ ID NO: 2927 - DNA, 16 bp, Vaccinia Virus
atacccaggtcaattc

SEQ ID NO: 2928 - DNA, 18 bp, Vaccinia Virus
agcagctctggtctgtca

SEQ ID NO: 2929 - DNA, 25 bp, Vaccinia Virus
gaatatgtttgtgtatgttcacatg

SEQ ID NO: 2930 - DNA, 23 bp, Vaccinia Virus
aggcttcagtaaagcagaggcta

SEQ ID NO: 2931 - DNA, 18 bp, Vaccinia Virus
aagtcctaggagcacaca

SEQ ID NO: 2932 - DNA, 20 bp, Vaccinia Virus
aaatggttaagggtatatca

SEQ ID NO: 2933 - DNA, 21 bp, Vaccinia Virus
actagaatctctagaatttga

SEQ ID NO: 2934 - DNA, 23 bp, Vaccinia Virus
tggaaaggagaaacttgcagtca

SEQ ID NO: 2935 - DNA, 19 bp, Vaccinia Virus
caagtgatgaatatgctca

SEQ ID NO: 2936 - DNA, 22 bp, Vaccinia Virus
taaagtttgattggaacatacc

SEQ ID NO: 2937 - DNA, 19 bp, Vaccinia Virus
gagctcttcggtagcctca

SEQ ID NO: 2938 - DNA, 22 bp, Vaccinia Virus
gaaaagcaataaaaatatttta

SEQ ID NO: 2939 - DNA, 16 bp, Vaccinia Virus
tagccacagaaatgtc

SEQ ID NO: 2940 - DNA, 17 bp, Vaccinia Virus
tcctcattggtaaaaga

SEQ ID NO: 2941 - DNA, 24 bp, Vaccinia Virus
tccacccttgccctcagcaagaga

SEQ ID NO: 2942 - DNA, 22 bp, Vaccinia Virus
cgattttcatataaatgtatga

SEQ ID NO: 2943 - DNA, 20 bp, Vaccinia Virus
ccattacagtggcctggata

SEQ ID NO: 2944 - DNA, 23 bp, Vaccinia Virus
gaaaaccgtctcataacaaaagg

SEQ ID NO: 2945 - DNA, 19 bp, Vaccinia Virus
atgatcctaaactttttgg

SEQ ID NO: 2946 - DNA, 18 bp, Vaccinia Virus
tgagctttgtaccaaaga

SEQ ID NO: 2947 - DNA, 18 bp, Vaccinia Virus
cagatgaatagtatcaca

SEQ ID NO: 2948 - DNA, 19 bp, Vaccinia Virus
tatgttgattctacctgtg

SEQ ID NO: 2949 - DNA, 21 bp, Vaccinia Virus
agaatccatgctaaaaattaa

SEQ ID NO: 2950 - DNA, 20 bp, Vaccinia Virus
ccctggtggcataaacgagt

SEQ ID NO: 2951 - DNA, 24 bp, Vaccinia Virus
cagaaatctgctgcatttcacatg

SEQ ID NO: 2952 - DNA, 18 bp, Vaccinia Virus
tggttggtaatggaataa

SEQ ID NO: 2953 - DNA, 19 bp, Vaccinia Virus
aaaaaatggtgttttatct

SEQ ID NO: 2954 - DNA, 19 bp, Vaccinia Virus
aggttaggagaaaacctca

SEQ ID NO: 2955 - DNA, 17 bp, Vaccinia Virus
ctcacatggacccaaga

SEQ ID NO: 2956 - DNA, 19 bp, Vaccinia Virus
gtcatataaatgagtgaaa

SEQ ID NO: 2957 - DNA, 17 bp, Vaccinia Virus
tagtcacagagtggctg

SEQ ID NO: 2958 - DNA, 19 bp, Vaccinia Virus
ttactagcattgcagtgtc

SEQ ID NO: 2959 - DNA, 19 bp, Vaccinia Virus
ttctcatagatattttgtg

SEQ ID NO: 2960 - DNA, 18 bp, Vaccinia Virus
gtctagagtgatccatcc

SEQ ID NO: 2961 - DNA, 18 bp, Vaccinia Virus
atgttgacctgagctagt

SEQ ID NO: 2962 - DNA, 18 bp, Vaccinia Virus
tgtagacatgaagactta

SEQ ID NO: 2963 - DNA, 18 bp, Vaccinia Virus
catggccaccgcagaaca

SEQ ID NO: 2964 - DNA, 18 bp, Vaccinia Virus
gaaaaggcctctgtggag

SEQ ID NO: 2965 - DNA, 21 bp, Vaccinia Virus
taaaaaaaggagcaaaagtat

SEQ ID NO: 2966 - DNA, 18 bp, Vaccinia Virus
tatgccgaaatagcttca

SEQ ID NO: 2967 - DNA, 17 bp, Vaccinia Virus
aggcagaaggatcactt

SEQ ID NO: 2968 - DNA, 20 bp, Vaccinia Virus
tagaaatagttgacttaata

SEQ ID NO: 2969 - DNA, 19 bp, Vaccinia Virus
gaaaggagacagaacatta

SEQ ID NO: 2970 - DNA, 18 bp, Vaccinia Virus
aaaagaaatccgaaagaa

SEQ ID NO: 2971 - DNA, 17 bp, Vaccinia Virus
atttttattctctgctt

SEQ ID NO: 2972 - DNA, 18 bp, Vaccinia Virus
tggaaacatgttgtggaa

SEQ ID NO: 2973 - DNA, 27 bp, Vaccinia Virus
caacatcttggcttttagttactggca

SEQ ID NO: 2974 - DNA, 23 bp, Vaccinia Virus
gatagacttatcatagctctata

SEQ ID NO: 2975 - DNA, 21 bp, Vaccinia Virus
taaatgtttagaacctactgt

SEQ ID NO: 2976 - DNA, 20 bp, Vaccinia Virus
tatgttgaaaaactgctgtg

SEQ ID NO: 2977 - DNA, 20 bp, Vaccinia Virus
acctatgggcagtttatctg

SEQ ID NO: 2978 - DNA, 17 bp, Vaccinia Virus
tgtgacatgaccaaaga

SEQ ID NO: 2979 - DNA, 24 bp, Vaccinia Virus
ttctccaggccctcagatggcaca

SEQ ID NO: 2980 - DNA, 21 bp, Vaccinia Virus
tagttctgaattaaaatatgc

SEQ ID NO: 2981 - DNA, 20 bp, Vaccinia Virus
gagaacgatgctctgtgaga

SEQ ID NO: 2982 - DNA, 29 bp, Vaccinia Virus
tatcatctctggaagttgagagcctccaa

SEQ ID NO: 2983 - DNA, 22 bp, Vaccinia Virus
cttatctgttatgtgttcatca

SEQ ID NO: 2984 - DNA, 20 bp, Vaccinia Virus
tgggccatttttccacaaca

SEQ ID NO: 2985 - DNA, 20 bp, Vaccinia Virus
tatttttatctctatctcct

SEQ ID NO: 2986 - DNA, 20 bp, Vaccinia Virus
caaggtccaaactgatataa

SEQ ID NO: 2987 - DNA, 21 bp, Vaccinia Virus
tgcaattttttttaccaaaga

SEQ ID NO: 2988 - DNA, 21 bp, Vaccinia Virus
ttattaactccttctctcttt

SEQ ID NO: 2989 - DNA, 20 bp, Vaccinia Virus
ttatgcaaaaaagtatctta

SEQ ID NO: 2990 - DNA, 21 bp, Vaccinia Virus
tctacctcagtttgccacaaa

SEQ ID NO: 2991 - DNA, 20 bp, Vaccinia Virus
aaataaaaacaggaatatta

SEQ ID NO: 2992 - DNA, 21 bp, Vaccinia Virus
tgtttctaagccattgactaa

SEQ ID NO: 2993 - DNA, 17 bp, Vaccinia Virus
tagaaatagttctttaa

SEQ ID NO: 2994 - DNA, 18 bp, Vaccinia Virus
ccaaagaagatccgagtt

SEQ ID NO: 2995 - DNA, 23 bp, Vaccinia Virus
attaagtaatccaccatttctta

SEQ ID NO: 2996 - DNA, 23 bp, Vaccinia Virus
gtctcacatttggcccaaacctc

SEQ ID NO: 2997 - DNA, 22 bp, Vaccinia Virus
caggagtacctttctccacatg

SEQ ID NO: 2998 - DNA, 23 bp, Vaccinia Virus
ccaagaatttatctccaaaggaa

SEQ ID NO: 2999 - DNA, 17 bp, Vaccinia Virus
aggcaggataatcactt

SEQ ID NO: 3000 - DNA, 21 bp, Vaccinia Virus
actgcagcctccgcttcctgt

SEQ ID NO: 3001 - DNA, 17 bp, Vaccinia Virus
ttgccaagaaagacccc

SEQ ID NO: 3002 - DNA, 22 bp, Vaccinia Virus
aatataaaaacagaaacataga

SEQ ID NO: 3003 - DNA, 19 bp, Vaccinia Virus
ttatacttagaacttacca

SEQ ID NO: 3004 - DNA, 23 bp, Vaccinia Virus
aataaatgggagttagcatttta

SEQ ID NO: 3005 - DNA, 18 bp, Vaccinia Virus
tgagaaggccttattaaa

SEQ ID NO: 3006 - DNA, 23 bp, Vaccinia Virus
atttgttttctctttctttcctc

SEQ ID NO: 3007 - DNA, 20 bp, Vaccinia Virus
ttgcttctgaaacccctcct

SEQ ID NO: 3008 - DNA, 20 bp, Vaccinia Virus
ggcaaacacctgacatggca

SEQ ID NO: 3009 - DNA, 21 bp, Vaccinia Virus
aagcagaacagatacctaatt

SEQ ID NO: 3010 - DNA, 22 bp, Vaccinia Virus
aggactatagaaatgcaaagaa

SEQ ID NO: 3011 - DNA, 22 bp, Vaccinia Virus
aaaatattaagataactttctg

SEQ ID NO: 3012 - DNA, 19 bp, Vaccinia Virus
ggcacctataataaatgac

SEQ ID NO: 3013 - DNA, 20 bp, Vaccinia Virus
ttccagcctgaacccatgga

SEQ ID NO: 3014 - DNA, 16 bp, Vaccinia Virus
aaaaggaaaaaagcca

SEQ ID NO: 3015 - DNA, 19 bp, Vaccinia Virus
tagaattgggactttagta

SEQ ID NO: 3016 - DNA, 19 bp, Vaccinia Virus
gtcatatgttaaagagcta

SEQ ID NO: 3017 - DNA, 17 bp, Vaccinia Virus
atgttacatgcaccttc

SEQ ID NO: 3018 - DNA, 22 bp, Vaccinia Virus
atatttctgaggctttttttgt

SEQ ID NO: 3019 - DNA, 19 bp, Vaccinia Virus
gccaatgggggaattctca

SEQ ID NO: 3020 - DNA, 25 bp, Vaccinia Virus
ctcaacacaccaagccttattccca

SEQ ID NO: 3021 - DNA, 20 bp, Vaccinia Virus
tcacttgagaagttgttagg

SEQ ID NO: 3022 - DNA, 19 bp, Vaccinia Virus
cactaccgctgtatctgta

SEQ ID NO: 3023 - DNA, 23 bp, Vaccinia Virus
tacagtgaggcgagattcaccat

SEQ ID NO: 3024 - DNA, 23 bp, Vaccinia Virus
cctgcccacaacttctccaaaca

SEQ ID NO: 3025 - DNA, 23 bp, Vaccinia Virus
actttgggaaattcatctggtca

SEQ ID NO: 3026 - DNA, 21 bp, Vaccinia Virus
tccaccctatttctggaaaaa

SEQ ID NO: 3027 - DNA, 21 bp, Vaccinia Virus
cttatccatctctgtccatta

SEQ ID NO: 3028 - DNA, 21 bp, Vaccinia Virus
acactgtgttccttggacctc

SEQ ID NO: 3029 - DNA, 20 bp, Vaccinia Virus
cagctccaccatatttctcc

SEQ ID NO: 3030 - DNA, 19 bp, Vaccinia Virus
tctgtaccttctccatcca

SEQ ID NO: 3031 - DNA, 21 bp, Vaccinia Virus
gaaaagagttctaaacatggt

SEQ ID NO: 3032 - DNA, 19 bp, Vaccinia Virus
aggttggaaaaggctccgc

SEQ ID NO: 3033 - DNA, 18 bp, Vaccinia Virus
tgagcacgcttggaatac

SEQ ID NO: 3034 - DNA, 20 bp, Vaccinia Virus
ttggaaataagtcaatggaa

SEQ ID NO: 3035 - DNA, 18 bp, Vaccinia Virus
caacaaacaagagctatg

SEQ ID NO: 3036 - DNA, 19 bp, Vaccinia Virus
tctcatagatactagttga

SEQ ID NO: 3037 - DNA, 23 bp, Vaccinia Virus
ctgaccttgaaataaatcacttc

SEQ ID NO: 3038 - DNA, 19 bp, Vaccinia Virus
taataaacgatttaatgaa

SEQ ID NO: 3039 - DNA, 16 bp, Vaccinia Virus
agtttgaaatcatgcc

SEQ ID NO: 3040 - DNA, 18 bp, Vaccinia Virus
cgtagatgatgtgaatga

SEQ ID NO: 3041 - DNA, 22 bp, Vaccinia Virus
cagttgggccctgtaccatccc

SEQ ID NO: 3042 - DNA, 24 bp, Vaccinia Virus
caagaaaaatgagaacattttcaa

SEQ ID NO: 3043 - DNA, 20 bp, Vaccinia Virus
gttaggtgtcaattgatact

SEQ ID NO: 3044 - DNA, 17 bp, Vaccinia Virus
tgagaggctttatgaaa

SEQ ID NO: 3045 - DNA, 23 bp, Vaccinia Virus
ttaacatagaatgtttactgata

SEQ ID NO: 3046 - DNA, 22 bp, Vaccinia Virus
aatacagttgcagaggagcata

SEQ ID NO: 3047 - DNA, 16 bp, Vaccinia Virus
aaggtataataaactg

SEQ ID NO: 3048 - DNA, 17 bp, Vaccinia Virus
tagtcacaacccaatgc

SEQ ID NO: 3049 - DNA, 17 bp, Vaccinia Virus
gatggccagaagattta

SEQ ID NO: 3050 - DNA, 22 bp, Vaccinia Virus
ggagtaacaaaataggacatta

SEQ ID NO: 3051 - DNA, 22 bp, Vaccinia Virus
cgatgatctggccgaagagctt

SEQ ID NO: 3052 - DNA, 19 bp, Vaccinia Virus
aatttgacatcacatttta

SEQ ID NO: 3053 - DNA, 18 bp, Vaccinia Virus
ggaaacaaacaaaaagga

SEQ ID NO: 3054 - DNA, 19 bp, Vaccinia Virus
agaaataggcgtactttaa

SEQ ID NO: 3055 - DNA, 21 bp, Vaccinia Virus
atggagaatctctgggatagc

SEQ ID NO: 3056 - DNA, 18 bp, Vaccinia Virus
gttctcattcttttcact

SEQ ID NO: 3057 - DNA, 21 bp, Vaccinia Virus
aatttgtgatttgtttaattt

SEQ ID NO: 3058 - DNA, 18 bp, Vaccinia Virus
ttctctccttctctcttc

SEQ ID NO: 3059 - DNA, 20 bp, Vaccinia Virus
tagagaagggaaagacttta

SEQ ID NO: 3060 - DNA, 20 bp, Vaccinia Virus
gcctatcagaagtcaattca

SEQ ID NO: 3061 - DNA, 17 bp, Vaccinia Virus
gagggagtcattttatt

SEQ ID NO: 3062 - DNA, 18 bp, Vaccinia Virus
tcactcaaacggaatcga

SEQ ID NO: 3063 - DNA, 22 bp, Vaccinia Virus
gaatacttagtattttcacatg

SEQ ID NO: 3064 - DNA, 20 bp, Vaccinia Virus
agtctaaacacaaaattcat

SEQ ID NO: 3065 - DNA, 17 bp, Vaccinia Virus
ttctgtcccaccagaaa

SEQ ID NO: 3066 - DNA, 20 bp, Vaccinia Virus
tagagaagggaaagacttta

SEQ ID NO: 3067 - DNA, 23 bp, Vaccinia Virus
tgaatctgccagcaccataactt

SEQ ID NO: 3068 - DNA, 17 bp, Vaccinia Virus
aggcaggataatcactt

SEQ ID NO: 3069 - DNA, 18 bp, Vaccinia Virus
tgatgccgaggaaagact

SEQ ID NO: 3070 - DNA, 21 bp, Vaccinia Virus
aatattcaatattcttaaaga

SEQ ID NO: 3071 - DNA, 18 bp, Vaccinia Virus
atttctcgtgaacaccca

SEQ ID NO: 3072 - DNA, 18 bp, Vaccinia Virus
aaaaatttttgtataatg

SEQ ID NO: 3073 - DNA, 19 bp, Vaccinia Virus
tattttattacagattgga

SEQ ID NO: 3074 - DNA, 18 bp, Vaccinia Virus
ttggaaatatcttctgtg

SEQ ID NO: 3075 - DNA, 18 bp, Vaccinia Virus
ttctctccttctctcttc

SEQ ID NO: 3076 - DNA, 20 bp, Vaccinia Virus
gctcgaaaaggcaaaggcta

SEQ ID NO: 3077 - DNA, 20 bp, Vaccinia Virus
ttgataatgttgtgcaaagg

SEQ ID NO: 3078 - DNA, 23 bp, Vaccinia Virus
caggaatacagagatttcgcatg

SEQ ID NO: 3079 - DNA, 20 bp, Vaccinia Virus
gccatgagctgcatctttat

SEQ ID NO: 3080 - DNA, 21 bp, Vaccinia Virus
aaagttgtgtaaagtgacgaa

SEQ ID NO: 3081 - DNA, 19 bp, Vaccinia Virus
acaagcaaatgtaactcca

SEQ ID NO: 3082 - DNA, 19 bp, Vaccinia Virus
cggaatttggaaaccccag

SEQ ID NO: 3083 - DNA, 21 bp, Vaccinia Virus
ttctgaaataatctctggagg

SEQ ID NO: 3084 - DNA, 21 bp, Vaccinia Virus
aagtgccacaaaatgaactaa

SEQ ID NO: 3085 - DNA, 17 bp, Vaccinia Virus
cctaggtctggccttca

SEQ ID NO: 3086 - DNA, 24 bp, Vaccinia Virus
aatgcaagaaggaacacataagta

SEQ ID NO: 3087 - DNA, 19 bp, Vaccinia Virus
acagcaatcaaaacatcaa

SEQ ID NO: 3088 - DNA, 18 bp, Vaccinia Virus
tctccaagaagggtgtca

SEQ ID NO: 3089 - DNA, 20 bp, Vaccinia Virus
gaaactcacaaagcaatgct

SEQ ID NO: 3090 - DNA, 19 bp, Vaccinia Virus
ttttggtggctcgatgtta

SEQ ID NO: 3091 - DNA, 18 bp, Vaccinia Virus
tagaacatttaccgatgc

SEQ ID NO: 3092 - DNA, 24 bp, Vaccinia Virus
ctattttatagccacccaggtagg

SEQ ID NO: 3093 - DNA, 20 bp, Vaccinia Virus
gacagtcatgcatttctata

SEQ ID NO: 3094 - DNA, 22 bp, Vaccinia Virus
gcagtgcaaacatcattttgga

SEQ ID NO: 3095 - DNA, 23 bp, Vaccinia Virus
cagttaaacctagatccctccct

SEQ ID NO: 3096 - DNA, 20 bp, Vaccinia Virus
gaagagaaatgccataggaa

SEQ ID NO: 3097 - DNA, 21 bp, Vaccinia Virus
acaattgtcaagtatattctg

SEQ ID NO: 3098 - DNA, 24 bp, Vaccinia Virus
gatgccgaggacatcttactcctg

SEQ ID NO: 3099 - DNA, 23 bp, Vaccinia Virus
tcctgccaccatttctccaacca

SEQ ID NO: 3100 - DNA, 16 bp, Vaccinia Virus
gatgccgaagaaggct

SEQ ID NO: 3101 - DNA, 18 bp, Vaccinia Virus
tcccttccccactccatg

SEQ ID NO: 3102 - DNA, 22 bp, Vaccinia Virus
agaaaacttgacattcagatga

SEQ ID NO: 3103 - DNA, 19 bp, Vaccinia Virus
agcagccgtggacacaacg

SEQ ID NO: 3104 - DNA, 23 bp, Vaccinia Virus
aaggttggtttatttgtatttta

SEQ ID NO: 3105 - DNA, 18 bp, Vaccinia Virus
agatgcaggctcagcact

SEQ ID NO: 3106 - DNA, 19 bp, Vaccinia Virus
aagtagaaatctcaaagat

SEQ ID NO: 3107 - DNA, 16 bp, Vaccinia Virus
caacattttatttcca

SEQ ID NO: 3108 - DNA, 20 bp, Vaccinia Virus
ataccagtggcaaatttgga

SEQ ID NO: 3109 - DNA, 23 bp, Vaccinia Virus
ctattactattgcaggaatataa

SEQ ID NO: 3110 - DNA, 20 bp, Vaccinia Virus
aaaagtgctgcaaaaatatt

SEQ ID NO: 3111 - DNA, 16 bp, Vaccinia Virus
agtcacagatcacgcc

SEQ ID NO: 3112 - DNA, 19 bp, Vaccinia Virus
gagaaaaaccatataaatg

SEQ ID NO: 3113 - DNA, 17 bp, Vaccinia Virus
aggcaggataatcactt

SEQ ID NO: 3114 - DNA, 21 bp, Vaccinia Virus
ctctggtgtgactaaggaaag

SEQ ID NO: 3115 - DNA, 18 bp, Vaccinia Virus
atgtatatagatatgatc

SEQ ID NO: 3116 - DNA, 16 bp, Vaccinia Virus
ggagtctccatcctca

SEQ ID NO: 3117 - DNA, 23 bp, Vaccinia Virus
ctccagacccagatggtgtctca

SEQ ID NO: 3118 - DNA, 22 bp, Vaccinia Virus
agccaacacatatggtcaatga

SEQ ID NO: 3119 - DNA, 18 bp, Vaccinia Virus
cttgataaaaacaactaa

SEQ ID NO: 3120 - DNA, 20 bp, Vaccinia Virus
tctacctcttctgccacaaa

SEQ ID NO: 3121 - DNA, 22 bp, Vaccinia Virus
cagctggacctagctgattctc

SEQ ID NO: 3122 - DNA, 22 bp, Vaccinia Virus
cttggttagtatttgattccca

SEQ ID NO: 3123 - DNA, 21 bp, Vaccinia Virus
actgaaattcagaagattcac

SEQ ID NO: 3124 - DNA, 20 bp, Vaccinia Virus
gaaaatggggcccttaatac

SEQ ID NO: 3125 - DNA, 20 bp, Vaccinia Virus
ctagacaacatgaccctacc

SEQ ID NO: 3126 - DNA, 17 bp, Vaccinia Virus
ctgcatctctcccctta

SEQ ID NO: 3127 - DNA, 20 bp, Vaccinia Virus
ggtaaaggagtgttgaactc

SEQ ID NO: 3128 - DNA, 20 bp, Vaccinia Virus
atgcccactgacctttttca

SEQ ID NO: 3129 - DNA, 16 bp, Vaccinia Virus
agtcacagcagccgcc

SEQ ID NO: 3130 - DNA, 18 bp, Vaccinia Virus
aggagtttagtatcctta

SEQ ID NO: 3131 - DNA, 21 bp, Vaccinia Virus
atttttcagatctttctcttt

SEQ ID NO: 3132 - DNA, 21 bp, Vaccinia Virus
taatgtgaggaaaaacacgga

SEQ ID NO: 3133 - DNA, 19 bp, Vaccinia Virus
ttggaaattagaggtggaa

SEQ ID NO: 3134 - DNA, 20 bp, Vaccinia Virus
aaaaggcaaaagtttgcagc

SEQ ID NO: 3135 - DNA, 21 bp, Vaccinia Virus
atgcctacaaaggaaatgagt

SEQ ID NO: 3136 - DNA, 18 bp, Vaccinia Virus
ttaagagaaaaaagtacc

SEQ ID NO: 3137 - DNA, 17 bp, Vaccinia Virus
ctccacaacatctacca

SEQ ID NO: 3138 - DNA, 21 bp, Vaccinia Virus
cagccctgccactccttcctc

SEQ ID NO: 3139 - DNA, 16 bp, Vaccinia Virus
ggaaagccctgtggaa

SEQ ID NO: 3140 - DNA, 26 bp, Vaccinia Virus
agaactttatttaccatgaaatgcct

SEQ ID NO: 3141 - DNA, 24 bp, Vaccinia Virus
gagacagaatctttagttacttca

SEQ ID NO: 3142 - DNA, 17 bp, Vaccinia Virus
cagaacaccacctctca

SEQ ID NO: 3143 - DNA, 23 bp, Vaccinia Virus
caaaatggaactttaaaacagta

SEQ ID NO: 3144 - DNA, 23 bp, Vaccinia Virus
caaaatggaactttaaaacagta

SEQ ID NO: 3145 - DNA, 23 bp, Vaccinia Virus
caaaatggaactttaaaacagta

SEQ ID NO: 3146 - DNA, 23 bp, Vaccinia Virus
caaaatggaactttaaaacagta

SEQ ID NO: 3147 - DNA, 20 bp, Vaccinia Virus
tgtaaacagaaggtcttcaa

SEQ ID NO: 3148 - DNA, 19 bp, Vaccinia Virus
tagcttgtgaaaccattcc

SEQ ID NO: 3149 - DNA, 23 bp, Vaccinia Virus
tgatagtggcatttatcaaatgg

SEQ ID NO: 3150 - DNA, 16 bp, Vaccinia Virus
aatcaacaggctcccg

SEQ ID NO: 3151 - DNA, 18 bp, Vaccinia Virus
agagaacagactttaata

SEQ ID NO: 3152 - DNA, 18 bp, Vaccinia Virus
gagaaagaagatatttta

SEQ ID NO: 3153 - DNA, 21 bp, Vaccinia Virus
tcagggatctagaactagaaa

SEQ ID NO: 3154 - DNA, 22 bp, Vaccinia Virus
tgtacagttatatttgtctata

SEQ ID NO: 3155 - DNA, 20 bp, Vaccinia Virus
aggagttacaaaatatggac

SEQ ID NO: 3156 - DNA, 25 bp, Vaccinia Virus
agcattaaaaaccagcagctcttca

SEQ ID NO: 3157 - DNA, 22 bp, Vaccinia Virus
attattcttagatctgtagata

SEQ ID NO: 3158 - DNA, 22 bp, Vaccinia Virus
taatttgaatctgaacatgtta

SEQ ID NO: 3159 - DNA, 16 bp, Vaccinia Virus
aaataaaaacagtatc

SEQ ID NO: 3160 - DNA, 19 bp, Vaccinia Virus
agtcacaaaaaccatgctg

SEQ ID NO: 3161 - DNA, 20 bp, Vaccinia Virus
ttattcaaaggccaatgata

SEQ ID NO: 3162 - DNA, 21 bp, Vaccinia Virus
atttctgggactgaatccagg

SEQ ID NO: 3163 - DNA, 20 bp, Vaccinia Virus
gaaaagaacaagaaagatag

SEQ ID NO: 3164 - DNA, 19 bp, Vaccinia Virus
gtttctagtgccaaactta

SEQ ID NO: 3165 - DNA, 18 bp, Vaccinia Virus
atggaggcattatttcta

SEQ ID NO: 3166 - DNA, 16 bp, Vaccinia Virus
agatgaggatgagcgt

SEQ ID NO: 3167 - DNA, 19 bp, Vaccinia Virus
tagtcacaaagggcttacg

SEQ ID NO: 3168 - DNA, 23 bp, Vaccinia Virus
ttggaaatcagcttctggaggaa

SEQ ID NO: 3169 - DNA, 18 bp, Vaccinia Virus
gtggacagcattgagctc

SEQ ID NO: 3170 - DNA, 16 bp, Vaccinia Virus
aatggagagacttccg

SEQ ID NO: 3171 - DNA, 18 bp, Vaccinia Virus
tcacccaaacactccttc

SEQ ID NO: 3172 - DNA, 25 bp, Vaccinia Virus
aagcaaagaaaaatacctaattgta

SEQ ID NO: 3173 - DNA, 18 bp, Vaccinia Virus
ttctagggaaaccacaaa

SEQ ID NO: 3174 - DNA, 18 bp, Vaccinia Virus
atttggctgatgatggaa

SEQ ID NO: 3175 - DNA, 16 bp, Vaccinia Virus
gtgtgtcttgtgctgc

SEQ ID NO: 3176 - DNA, 21 bp, Vaccinia Virus
ataaagttacacaaaggtagt

SEQ ID NO: 3177 - DNA, 17 bp, Vaccinia Virus
ctcaatcagtattgcca

SEQ ID NO: 3178 - DNA, 26 bp, Vaccinia Virus
gatggacccttcaagcaatttctata

SEQ ID NO: 3179 - DNA, 19 bp, Vaccinia Virus
ggaccacatcagttgcaaa

SEQ ID NO: 3180 - DNA, 22 bp, Vaccinia Virus
tagaaatggttgtactttaatg

SEQ ID NO: 3181 - DNA, 20 bp, Vaccinia Virus
atccctgttttcggggacta

SEQ ID NO: 3182 - DNA, 17 bp, Vaccinia Virus
aaaggtatatttgacta

SEQ ID NO: 3183 - DNA, 23 bp, Vaccinia Virus
tagaaaatggccagattttaata

SEQ ID NO: 3184 - DNA, 26 bp, Vaccinia Virus
aaccatgaaagacagagttgatctca

SEQ ID NO: 3185 - DNA, 22 bp, Vaccinia Virus
aaaatgcagtttttccttcaca

SEQ ID NO: 3186 - DNA, 18 bp, Vaccinia Virus
aaacaaatactgagacag

SEQ ID NO: 3187 - DNA, 19 bp, Vaccinia Virus
aagaaatattacaataagg

SEQ ID NO: 3188 - DNA, 18 bp, Vaccinia Virus
aacggttgccggccattg

SEQ ID NO: 3189 - DNA, 18 bp, Vaccinia Virus
ctaatgaaaaggacctta

SEQ ID NO: 3190 - DNA, 19 bp, Vaccinia Virus
tatttagctttggaaactt

SEQ ID NO: 3191 - DNA, 25 bp, Vaccinia Virus
aatcagatcatatgaaaacaatcta

SEQ ID NO: 3192 - DNA, 18 bp, Vaccinia Virus
aatgaaaagaacttccca

SEQ ID NO: 3193 - DNA, 21 bp, Vaccinia Virus
aagggtgaaatttgtgtttta

SEQ ID NO: 3194 - DNA, 21 bp, Vaccinia Virus
agcagatcaagcaaatgtcta

SEQ ID NO: 3195 - DNA, 23 bp, Vaccinia Virus
aatattttgccttctttctttct

SEQ ID NO: 3196 - DNA, 23 bp, Vaccinia Virus
ctccagacccagatggtgtctca

SEQ ID NO: 3197 - DNA, 17 bp, Vaccinia Virus
agctatttgtagataaa

SEQ ID NO: 3198 - DNA, 22 bp, Vaccinia Virus
attgcgtttctctttctccttc

SEQ ID NO: 3199 - DNA, 16 bp, Vaccinia Virus
agccacaggagatgtc

SEQ ID NO: 3200 - DNA, 19 bp, Vaccinia Virus
ccacagtgtcatcccacag

SEQ ID NO: 3201 - DNA, 23 bp, Vaccinia Virus
gtccaaaagtttaactgtcctgc

SEQ ID NO: 3202 - DNA, 18 bp, Vaccinia Virus
acaaagctatcacatgaa

SEQ ID NO: 3203 - DNA, 19 bp, Vaccinia Virus
agcttcccattgtgtaata

SEQ ID NO: 3204 - DNA, 19 bp, Vaccinia Virus
aaatcttgtgctctgcgaa

SEQ ID NO: 3205 - DNA, 19 bp, Vaccinia Virus
aaataaagatagcatgtca

SEQ ID NO: 3206 - DNA, 23 bp, Vaccinia Virus
tgcacagctgtttaggctataga

SEQ ID NO: 3207 - DNA, 19 bp, Vaccinia Virus
ttctgaaataatttcaagc

SEQ ID NO: 3208 - DNA, 19 bp, Vaccinia Virus
ttgcatgttaaatgatact

SEQ ID NO: 3209 - DNA, 22 bp, Vaccinia Virus
ttctccagataagaaaatcaca

SEQ ID NO: 3210 - DNA, 23 bp, Vaccinia Virus
tctccaggccccaggtgccagca

SEQ ID NO: 3211 - DNA, 20 bp, Vaccinia Virus
gaaaggacatctacaccgaa

SEQ ID NO: 3212 - DNA, 20 bp, Vaccinia Virus
actgcactaacccatttgtg

SEQ ID NO: 3213 - DNA, 17 bp, Vaccinia Virus
agtcacagaacatctcc

SEQ ID NO: 3214 - DNA, 18 bp, Vaccinia Virus
atcattgcccccaactcc

SEQ ID NO: 3215 - DNA, 18 bp, Vaccinia Virus
tgttctctctctctcttt

SEQ ID NO: 3216 - DNA, 21 bp, Vaccinia Virus
ttctgcagggacaccacttat

SEQ ID NO: 3217 - DNA, 19 bp, Vaccinia Virus
ggtactaattcagcaccta

SEQ ID NO: 3218 - DNA, 19 bp, Vaccinia Virus
agtgagccgagaccatgcc

SEQ ID NO: 3219 - DNA, 27 bp, Vaccinia Virus
atagaaacagaggacgtgactttgata

SEQ ID NO: 3220 - DNA, 20 bp, Vaccinia Virus
tctcataggactgtcctaga

SEQ ID NO: 3221 - DNA, 23 bp, Vaccinia Virus
agcatcctttcaataaatgcctg

SEQ ID NO: 3222 - DNA, 18 bp, Vaccinia Virus
atttcccgtgaacaccca

SEQ ID NO: 3223 - DNA, 17 bp, Vaccinia Virus
tcatatgaagaaagcta

SEQ ID NO: 3224 - DNA, 21 bp, Vaccinia Virus
tccacacatttaaaacattga

SEQ ID NO: 3225 - DNA, 22 bp, Vaccinia Virus
aaagaattatattgctgacaaa

SEQ ID NO: 3226 - DNA, 20 bp, Vaccinia Virus
tggtagtgcagctcatctga

SEQ ID NO: 3227 - DNA, 21 bp, Vaccinia Virus
cagccccggagccattcctcc

SEQ ID NO: 3228 - DNA, 22 bp, Vaccinia Virus
cctgttccccacctcccggctc

SEQ ID NO: 3229 - DNA, 21 bp, Vaccinia Virus
gatggatgcatgcattatttc

SEQ ID NO: 3230 - DNA, 20 bp, Vaccinia Virus
aaactgcaatttggttccac

SEQ ID NO: 3231 - DNA, 21 bp, Vaccinia Virus
ctcagtgaaaacatcaattca

SEQ ID NO: 3232 - DNA, 22 bp, Vaccinia Virus
agcatcatcctcaaatatctca

SEQ ID NO: 3233 - DNA, 18 bp, Vaccinia Virus
acaaatcttgacgaacac

SEQ ID NO: 3234 - DNA, 19 bp, Vaccinia Virus
acggatgccactattgggc

SEQ ID NO: 3235 - DNA, 20 bp, Vaccinia Virus
gatattgaactgcatctgga

SEQ ID NO: 3236 - DNA, 18 bp, Vaccinia Virus
ctatggacaagccaagaa

SEQ ID NO: 3237 - DNA, 20 bp, Vaccinia Virus
gaagatcaagaggttacgtg

SEQ ID NO: 3238 - DNA, 18 bp, Vaccinia Virus
gccaagaaaaaaagctct

SEQ ID NO: 3239 - DNA, 23 bp, Vaccinia Virus
tattggcctgacagtccacctcc

SEQ ID NO: 3240 - DNA, 17 bp, Vaccinia Virus
ccgtagtggctccaaag

SEQ ID NO: 3241 - DNA, 25 bp, Vaccinia Virus
ctttaattttaaaaaacgtattcca

SEQ ID NO: 3242 - DNA, 23 bp, Vaccinia Virus
cagctgggctccatagaccctcc

SEQ ID NO: 3243 - DNA, 20 bp, Vaccinia Virus
aggcctcagtttatattgac

SEQ ID NO: 3244 - DNA, 18 bp, Vaccinia Virus
agtcacagatccgatgtc

SEQ ID NO: 3245 - DNA, 18 bp, Vaccinia Virus
agatgtgattacattact

SEQ ID NO: 3246 - DNA, 19 bp, Vaccinia Virus
aagttagtgctctgctgaa

SEQ ID NO: 3247 - DNA, 24 bp, Vaccinia Virus
atttttgggtgatgaatttacagt

SEQ ID NO: 3248 - DNA, 19 bp, Vaccinia Virus
aatgaggttgttatcaata

SEQ ID NO: 3249 - DNA, 18 bp, Vaccinia Virus
atgtcttctgaagactta

SEQ ID NO: 3250 - DNA, 18 bp, Vaccinia Virus
ttgccaagaaaacaatct

SEQ ID NO: 3251 - DNA, 21 bp, Vaccinia Virus
ccagtaggtgaagataaaggc

SEQ ID NO: 3252 - DNA, 19 bp, Vaccinia Virus
attttgcctttaccaaaga

SEQ ID NO: 3253 - DNA, 22 bp, Vaccinia Virus
ttctatcatcatctactacaaa

SEQ ID NO: 3254 - DNA, 21 bp, Vaccinia Virus
attcttttcccctctcttttc

SEQ ID NO: 3255 - DNA, 17 bp, Vaccinia Virus
agccacaggaagtgtcc

SEQ ID NO: 3256 - DNA, 22 bp, Vaccinia Virus
ataaaaaaggtacaaaaagtga

SEQ ID NO: 3257 - DNA, 22 bp, Vaccinia Virus
ggcagggtttttaaatagcatc

SEQ ID NO: 3258 - DNA, 19 bp, Vaccinia Virus
ttctcatagataatcaaga

SEQ ID NO: 3259 - DNA, 24 bp, Vaccinia Virus
actgaaacataatcaatggattca

SEQ ID NO: 3260 - DNA, 18 bp, Vaccinia Virus
tagtcacaaaattttacc

SEQ ID NO: 3261 - DNA, 18 bp, Vaccinia Virus
tggagttcaatgagctca

SEQ ID NO: 3262 - DNA, 21 bp, Vaccinia Virus
acataggggatagtagccaac

SEQ ID NO: 3263 - DNA, 19 bp, Vaccinia Virus
ccatcgtgctggtagaaga

SEQ ID NO: 3264 - DNA, 17 bp, Vaccinia Virus
acagaaactatagcaga

SEQ ID NO: 3265 - DNA, 18 bp, Vaccinia Virus
tgatacagcacaataact

SEQ ID NO: 3266 - DNA, 18 bp, Vaccinia Virus
tgtaattcttaataccat

SEQ ID NO: 3267 - DNA, 17 bp, Vaccinia Virus
ttttattcccttctctc

SEQ ID NO: 3268 - DNA, 19 bp, Vaccinia Virus
tccccttcctccctccatg

SEQ ID NO: 3269 - DNA, 21 bp, Vaccinia Virus
caaaacaaggcataaagaagt

SEQ ID NO: 3270 - DNA, 21 bp, Vaccinia Virus
aaaagagttctaaagaaatag

SEQ ID NO: 3271 - DNA, 22 bp, Vaccinia Virus
ctagacagatatccacttagta

SEQ ID NO: 3272 - DNA, 22 bp, Vaccinia Virus
ggcgacagagtgagtgagactc

SEQ ID NO: 3273 - DNA, 19 bp, Vaccinia Virus
aggcaggcgaattacttca

SEQ ID NO: 3274 - DNA, 27 bp, Vaccinia Virus
cttgacacgagactagtcccaattcca

SEQ ID NO: 3275 - DNA, 18 bp, Vaccinia Virus
aaacagtattaaccctgc

SEQ ID NO: 3276 - DNA, 17 bp, Vaccinia Virus
actagaagaggaacata

SEQ ID NO: 3277 - DNA, 15 bp, Vaccinia Virus
attatgagaaaggcc

SEQ ID NO: 3278 - DNA, 22 bp, Vaccinia Virus
ggtggcgggtaacgccggactc

SEQ ID NO: 3279 - DNA, 20 bp, Vaccinia Virus
atttatggtgagaaaaatac

SEQ ID NO: 3280 - DNA, 19 bp, Vaccinia Virus
tcatagatacaatacttta

SEQ ID NO: 3281 - DNA, 18 bp, Vaccinia Virus
tatcaataaatagcaaac

SEQ ID NO: 3282 - DNA, 18 bp, Vaccinia Virus
cagctctcacattccttc

SEQ ID NO: 3283 - DNA, 20 bp, Vaccinia Virus
cgcacgctcagcaggcatga

SEQ ID NO: 3284 - DNA, 24 bp, Vaccinia Virus
aggctgaacagcaaacccagaggc

SEQ ID NO: 3285 - DNA, 23 bp, Vaccinia Virus
cagatgcatctgtttcagcccta

SEQ ID NO: 3286 - DNA, 22 bp, Vaccinia Virus
ccactgattttttttttctgga

SEQ ID NO: 3287 - DNA, 23 bp, Vaccinia Virus
taaatgtaattttatgtactgtt

SEQ ID NO: 3288 - DNA, 23 bp, Vaccinia Virus
ctctgagtattgggaagagaggc

SEQ ID NO: 3289 - DNA, 26 bp, Vaccinia Virus
taaagtttacatgctacaaaaaatac

SEQ ID NO: 3290 - DNA, 24 bp, Vaccinia Virus
tggaaatcgccaaatttgtagcca

SEQ ID NO: 3291 - DNA, 21 bp, Vaccinia Virus
cagccccactcactccttctc

SEQ ID NO: 3292 - DNA, 18 bp, Vaccinia Virus
cacctgtttaaatgtctg

SEQ ID NO: 3293 - DNA, 21 bp, Vaccinia Virus
caggaatagaacttgcacatg

SEQ ID NO: 3294 - DNA, 21 bp, Vaccinia Virus
cccattccctaacctccaatc

SEQ ID NO: 3295 - DNA, 21 bp, Vaccinia Virus
gaaaaggaaataaaaaagcca

SEQ ID NO: 3296 - DNA, 23 bp, Vaccinia Virus
aaaatattaaacctggacctgat

SEQ ID NO: 3297 - DNA, 19 bp, Vaccinia Virus
gcatcccattggtgtcagt

SEQ ID NO: 3298 - DNA, 18 bp, Vaccinia Virus
ggaaggcatcctgtggaa

SEQ ID NO: 3299 - DNA, 21 bp, Vaccinia Virus
taatttatctgttaacatgtt

SEQ ID NO: 3300 - DNA, 21 bp, Vaccinia Virus
aataataacatatacaattaa

SEQ ID NO: 3301 - DNA, 23 bp, Vaccinia Virus
agactgtacaggaaacctaaggc

SEQ ID NO: 3302 - DNA, 18 bp, Vaccinia Virus
ttctcttcccctctcttc

SEQ ID NO: 3303 - DNA, 21 bp, Vaccinia Virus
cctacctgatattacatccta

SEQ ID NO: 3304 - DNA, 21 bp, Vaccinia Virus
cctacctgatattacatccta

SEQ ID NO: 3305 - DNA, 20 bp, Vaccinia Virus
ttctgatgacaaaccacaaa

SEQ ID NO: 3306 - DNA, 18 bp, Vaccinia Virus
tggagatgatccgtggaa

SEQ ID NO: 3307 - DNA, 19 bp, Vaccinia Virus
aaaactttatccattgaga

SEQ ID NO: 3308 - DNA, 19 bp, Vaccinia Virus
tgcaggaaagtttaccaaa

SEQ ID NO: 3309 - DNA, 20 bp, Vaccinia Virus
ctgtaacaaaataccacaaa

SEQ ID NO: 3310 - DNA, 16 bp, Vaccinia Virus
gtaattttcaaagatg

SEQ ID NO: 3311 - DNA, 22 bp, Vaccinia Virus
aacatcttcaacacagaacaca

SEQ ID NO: 3312 - DNA, 18 bp, Vaccinia Virus
tattctttctttctcttc

SEQ ID NO: 3313 - DNA, 21 bp, Vaccinia Virus
atcacctctggagccctttca

SEQ ID NO: 3314 - DNA, 25 bp, Vaccinia Virus
ccaaaataataatgaaaataaaggc

SEQ ID NO: 3315 - DNA, 20 bp, Vaccinia Virus
tccatatgtctatccactta

SEQ ID NO: 3316 - DNA, 18 bp, Vaccinia Virus
atgtaaacgcccacctta

SEQ ID NO: 3317 - DNA, 17 bp, Vaccinia Virus
tggaaagtgctctgtgg

SEQ ID NO: 3318 - DNA, 19 bp, Vaccinia Virus
tattcctgtctttctctct

SEQ ID NO: 3319 - DNA, 20 bp, Vaccinia Virus
ggaacaaaaacaggacatta

SEQ ID NO: 3320 - DNA, 17 bp, Vaccinia Virus
tgatgttagaatcccac

SEQ ID NO: 3321 - DNA, 19 bp, Vaccinia Virus
ttgtagtactggtaaaaga

SEQ ID NO: 3322 - DNA, 18 bp, Vaccinia Virus
actagctgcttctagtca

SEQ ID NO: 3323 - DNA, 18 bp, Vaccinia Virus
tattctgtctttctcctc

SEQ ID NO: 3324 - DNA, 20 bp, Vaccinia Virus
ttttgtgcctctctttcttc

SEQ ID NO: 3325 - DNA, 18 bp, Vaccinia Virus
cacacgtatgccatggcc

SEQ ID NO: 3326 - DNA, 19 bp, Vaccinia Virus
tctccagactggtgacaca

SEQ ID NO: 3327 - DNA, 18 bp, Vaccinia Virus
tattttgtttccctcttc

SEQ ID NO: 3328 - DNA, 23 bp, Vaccinia Virus
aaggaattatttccacgagacaa

SEQ ID NO: 3329 - DNA, 22 bp, Vaccinia Virus
accgcatttgctgctatctgtg

SEQ ID NO: 3330 - DNA, 23 bp, Vaccinia Virus
aggccgacaaccaccagaagctg

SEQ ID NO: 3331 - DNA, 23 bp, Vaccinia Virus
tctccggtggaaccagtgtcaca

SEQ ID NO: 3332 - DNA, 17 bp, Vaccinia Virus
ctgcatcttctgccact

SEQ ID NO: 3333 - DNA, 18 bp, Vaccinia Virus
ctgcattttagtccaact

SEQ ID NO: 3334 - DNA, 18 bp, Vaccinia Virus
gaatgatttggagttctt

SEQ ID NO: 3335 - DNA, 24 bp, Vaccinia Virus
tcaaatcccttttgtctctataca

SEQ ID NO: 3336 - DNA, 19 bp, Vaccinia Virus
atatttttattttcttcct

SEQ ID NO: 3337 - DNA, 19 bp, Vaccinia Virus
tgttctgcttttcctcctc

SEQ ID NO: 3338 - DNA, 19 bp, Vaccinia Virus
agctcctagaggctgctca

SEQ ID NO: 3339 - DNA, 18 bp, Vaccinia Virus
aatgtcatttttgttttt

SEQ ID NO: 3340 - DNA, 19 bp, Vaccinia Virus
attagtagcatgagtataa

SEQ ID NO: 3341 - DNA, 16 bp, Vaccinia Virus
caatggggcggtcata

SEQ ID NO: 3342 - DNA, 24 bp, Vaccinia Virus
gtttataccattggattcaattca

SEQ ID NO: 3343 - DNA, 19 bp, Vaccinia Virus
tgtaaaatacctctggata

SEQ ID NO: 3344 - DNA, 18 bp, Vaccinia Virus
tgtctgtgtttttaaaac

SEQ ID NO: 3345 - DNA, 21 bp, Vaccinia Virus
aacaaaccaaaaacggatatg

SEQ ID NO: 3346 - DNA, 20 bp, Vaccinia Virus
gtcatttctgatgaaagctg

SEQ ID NO: 3347 - DNA, 19 bp, Vaccinia Virus
tgtttaaaaacccaaaggc

SEQ ID NO: 3348 - DNA, 21 bp, Vaccinia Virus
ggttatatacatcataaatga

SEQ ID NO: 3349 - DNA, 21 bp, Vaccinia Virus
gaagtctcaaagcatcacttc

SEQ ID NO: 3350 - DNA, 17 bp, Vaccinia Virus
ggagtgtgctctgggaa

SEQ ID NO: 3351 - DNA, 18 bp, Vaccinia Virus
agattggttgctctggaa

SEQ ID NO: 3352 - DNA, 18 bp, Vaccinia Virus
tgcttcaaaatcaaagaa

SEQ ID NO: 3353 - DNA, 19 bp, Vaccinia Virus
actgaataactaaaatctc

SEQ ID NO: 3354 - DNA, 21 bp, Vaccinia Virus
aatgcagggagacatttgata

SEQ ID NO: 3355 - DNA, 21 bp, Vaccinia Virus
atccccctgatccaatcacct

SEQ ID NO: 3356 - DNA, 20 bp, Vaccinia Virus
gaaaggacaaaataaacaca

SEQ ID NO: 3357 - DNA, 19 bp, Vaccinia Virus
tggtcgacatcccacctcc

SEQ ID NO: 3358 - DNA, 19 bp, Vaccinia Virus
atcagtcaccaccaattcc

SEQ ID NO: 3359 - DNA, 17 bp, Vaccinia Virus
agtcacaggcaggtgcc

SEQ ID NO: 3360 - DNA, 19 bp, Vaccinia Virus
aggctccgcaaatatctca

SEQ ID NO: 3361 - DNA, 23 bp, Vaccinia Virus
taataacaaatgtttaattttta

SEQ ID NO: 3362 - DNA, 21 bp, Vaccinia Virus
tttttgtttttccccctcttc

SEQ ID NO: 3363 - DNA, 22 bp, Vaccinia Virus
actcatgatccaaaaaagatta

SEQ ID NO: 3364 - DNA, 21 bp, Vaccinia Virus
tatttttatcctcaacctctt

SEQ ID NO: 3365 - DNA, 22 bp, Vaccinia Virus
gaaatgggtcatactctgtgga

SEQ ID NO: 3366 - DNA, 22 bp, Vaccinia Virus
tgataccaacttgagataactt

SEQ ID NO: 3367 - DNA, 19 bp, Vaccinia Virus
gtgagcagactgctataga

SEQ ID NO: 3368 - DNA, 18 bp, Vaccinia Virus
agataaatgtgtgtcaca

SEQ ID NO: 3369 - DNA, 18 bp, Vaccinia Virus
atacttaataaatgacgt

SEQ ID NO: 3370 - DNA, 21 bp, Vaccinia Virus
gaaaagagtttctgcaagata

SEQ ID NO: 3371 - DNA, 17 bp, Vaccinia Virus
aggcagaaggatcactt

SEQ ID NO: 3372 - DNA, 20 bp, Vaccinia Virus
atcaacaaaaaggaggacca

SEQ ID NO: 3373 - DNA, 17 bp, Vaccinia Virus
tctgcatccattccact

SEQ ID NO: 3374 - DNA, 22 bp, Vaccinia Virus
cagctccgaccacaccatcctc

SEQ ID NO: 3375 - DNA, 18 bp, Vaccinia Virus
agtggcgattcaaagatg

SEQ ID NO: 3376 - DNA, 20 bp, Vaccinia Virus
ttgtgtgatttcgtaccaaa

SEQ ID NO: 3377 - DNA, 18 bp, Vaccinia Virus
cagctcaaaaacaacaac

SEQ ID NO: 3378 - DNA, 18 bp, Vaccinia Virus
gcctcagaaacataagtg

SEQ ID NO: 3379 - DNA, 23 bp, Vaccinia Virus
aggctggatgaagccaggggcta

SEQ ID NO: 3380 - DNA, 20 bp, Vaccinia Virus
atgaaaccatgcactttgta

SEQ ID NO: 3381 - DNA, 18 bp, Vaccinia Virus
tagtcacatggccacacc

SEQ ID NO: 3382 - DNA, 20 bp, Vaccinia Virus
tggaggggtgctctgtggaa

SEQ ID NO: 3383 - DNA, 22 bp, Vaccinia Virus
tgattcaacaatcttactcctg

SEQ ID NO: 3384 - DNA, 15 bp, Vaccinia Virus
aggggagtgttctca

SEQ ID NO: 3385 - DNA, 17 bp, Vaccinia Virus
aggcagaagaatcactt

SEQ ID NO: 3386 - DNA, 21 bp, Vaccinia Virus
aagggaatgtttaagccattt

SEQ ID NO: 3387 - DNA, 21 bp, Vaccinia Virus
ccacccttcactgtgctgcgg

SEQ ID NO: 3388 - DNA, 19 bp, Vaccinia Virus
tgatagctgataagactta

SEQ ID NO: 3389 - DNA, 18 bp, Vaccinia Virus
cagtcactaaaaacaatc

SEQ ID NO: 3390 - DNA, 20 bp, Vaccinia Virus
tggaaattgtttctgtagaa

SEQ ID NO: 3391 - DNA, 20 bp, Vaccinia Virus
tgatctcgtcaggagactta

SEQ ID NO: 3392 - DNA, 22 bp, Vaccinia Virus
aatgcttaggaatcattttata

SEQ ID NO: 3393 - DNA, 17 bp, Vaccinia Virus
cccaggaaaacatggat

SEQ ID NO: 3394 - DNA, 17 bp, Vaccinia Virus
tattttctttccctctc

SEQ ID NO: 3395 - DNA, 22 bp, Vaccinia Virus
aaagaaataaacttttggacag

SEQ ID NO: 3396 - DNA, 25 bp, Vaccinia Virus
tgccaaaaaaacaggtactcttcta

SEQ ID NO: 3397 - DNA, 25 bp, Vaccinia Virus
tgccaaaaaaacaggtactcttcta

SEQ ID NO: 3398 - DNA, 20 bp, Vaccinia Virus
gagccaaaagccagagccta

SEQ ID NO: 3399 - DNA, 17 bp, Vaccinia Virus
ctctggaaagccttcaa

SEQ ID NO: 3400 - DNA, 21 bp, Vaccinia Virus
ggataccgttttcaacttgga

SEQ ID NO: 3401 - DNA, 21 bp, Vaccinia Virus
gaagcagaagatactacttta

SEQ ID NO: 3402 - DNA, 17 bp, Vaccinia Virus
ggcatctacatggcatc

SEQ ID NO: 3403 - DNA, 19 bp, Vaccinia Virus
ggcatcttaacatggcatt

SEQ ID NO: 3404 - DNA, 20 bp, Vaccinia Virus
agcatatgaagacaggacat

SEQ ID NO: 3405 - DNA, 21 bp, Vaccinia Virus
taaaaaaaggagcaaaagtat

SEQ ID NO: 3406 - DNA, 21 bp, Vaccinia Virus
taaaaaaaggagcaaaagtat

SEQ ID NO: 3407 - DNA, 18 bp, Vaccinia Virus
tgtccttgttatcacttc

SEQ ID NO: 3408 - DNA, 18 bp, Vaccinia Virus
gtctgaaccgatatttct

SEQ ID NO: 3409 - DNA, 21 bp, Vaccinia Virus
agcatcctgattaaatgtctg

SEQ ID NO: 3410 - DNA, 24 bp, Vaccinia Virus
gagaaagagcaggtgaaatatttt

SEQ ID NO: 3411 - DNA, 20 bp, Vaccinia Virus
agctcagagctggtctgcca

SEQ ID NO: 3412 - DNA, 17 bp, Vaccinia Virus
aagtttctttgtgttca

SEQ ID NO: 3413 - DNA, 17 bp, Vaccinia Virus
gaaaatggatttgtagc

SEQ ID NO: 3414 - DNA, 18 bp, Vaccinia Virus
gcaaaaggcaacattgtt

SEQ ID NO: 3415 - DNA, 17 bp, Vaccinia Virus
ggtccatgaactaggaa

SEQ ID NO: 3416 - DNA, 21 bp, Vaccinia Virus
tgatctggcttggcagactta

SEQ ID NO: 3417 - DNA, 23 bp, Vaccinia Virus
tcctggtgattcttctccaatca

SEQ ID NO: 3418 - DNA, 16 bp, Vaccinia Virus
tccccttctccactcc

SEQ ID NO: 3419 - DNA, 16 bp, Vaccinia Virus
caatgagtggatcatg

SEQ ID NO: 3420 - DNA, 19 bp, Vaccinia Virus
ggcaggtaacattgagctc

SEQ ID NO: 3421 - DNA, 22 bp, Vaccinia Virus
tctggaaaacaacacacggtga

SEQ ID NO: 3422 - DNA, 17 bp, Vaccinia Virus
gccaatcaagaccagaa

SEQ ID NO: 3423 - DNA, 19 bp, Vaccinia Virus
agtcacagaaggactcgcc

SEQ ID NO: 3424 - DNA, 25 bp, Vaccinia Virus
gacacctggctgagccggaacagca

SEQ ID NO: 3425 - DNA, 24 bp, Vaccinia Virus
gatgccgaggacatcttactcctg

SEQ ID NO: 3426 - DNA, 23 bp, Vaccinia Virus
tcctgccaccatttctccaacca

SEQ ID NO: 3427 - DNA, 20 bp, Vaccinia Virus
aaacgatgatgatgttaacc

SEQ ID NO: 3428 - DNA, 22 bp, Vaccinia Virus
aacatcatatattttgatgtta

SEQ ID NO: 3429 - DNA, 19 bp, Vaccinia Virus
gccaaagccacaacttgga

SEQ ID NO: 3430 - DNA, 18 bp, Vaccinia Virus
agatgaaaccatggaagc

SEQ ID NO: 3431 - DNA, 19 bp, Vaccinia Virus
aggccacgggagccgaggc

SEQ ID NO: 3432 - DNA, 19 bp, Vaccinia Virus
ctaattcttcaattcttaa

SEQ ID NO: 3433 - DNA, 19 bp, Vaccinia Virus
gcttaagccattatttctg

SEQ ID NO: 3434 - DNA, 23 bp, Vaccinia Virus
gaaagaagaaacaatagaaaagg

SEQ ID NO: 3435 - DNA, 23 bp, Vaccinia Virus
aatatttttattctttgattctt

SEQ ID NO: 3436 - DNA, 22 bp, Vaccinia Virus
tatttttattctttgattcttc

SEQ ID NO: 3437 - DNA, 20 bp, Vaccinia Virus
gaagcagaaagaggttactt

SEQ ID NO: 3438 - DNA, 22 bp, Vaccinia Virus
atggagaaaattagcaatgctg

SEQ ID NO: 3439 - DNA, 15 bp, Vaccinia Virus
gccaactgcagtttg

SEQ ID NO: 3440 - DNA, 17 bp, Vaccinia Virus
tgctaatgccaaactta

SEQ ID NO: 3441 - DNA, 18 bp, Vaccinia Virus
aaaggtatttgggaaact

SEQ ID NO: 3442 - DNA, 22 bp, Vaccinia Virus
ctttgtgtttttggtttaccct

SEQ ID NO: 3443 - DNA, 18 bp, Vaccinia Virus
gcaaaaggcaacattgtt

SEQ ID NO: 3444 - DNA, 17 bp, Vaccinia Virus
ggtccatgaactaggaa

SEQ ID NO: 3445 - DNA, 21 bp, Vaccinia Virus
tgatctggcttggcagactta

SEQ ID NO: 3446 - DNA, 17 bp, Vaccinia Virus
ctccacaacatctacca

SEQ ID NO: 3447 - DNA, 20 bp, Vaccinia Virus
gcgagtgcctgtaatctccg

SEQ ID NO: 3448 - DNA, 18 bp, Vaccinia Virus
cctgatgtaggtcttatt

SEQ ID NO: 3449 - DNA, 22 bp, Vaccinia Virus
tcctacctatgtcttctccaat

SEQ ID NO: 3450 - DNA, 17 bp, Vaccinia Virus
gctgactactaaaactc

SEQ ID NO: 3451 - DNA, 23 bp, Vaccinia Virus
gaaaaacaaattcttaaatttca

SEQ ID NO: 3452 - DNA, 19 bp, Vaccinia Virus
ttcctattatatggtatcc

SEQ ID NO: 3453 - DNA, 21 bp, Vaccinia Virus
agcactgctgtaaatgtctag

SEQ ID NO: 3454 - DNA, 19 bp, Vaccinia Virus
attctagaaatggtgagaa

SEQ ID NO: 3455 - DNA, 18 bp, Vaccinia Virus
ccgtaaattacttcagag

SEQ ID NO: 3456 - DNA, 21 bp, Vaccinia Virus
ttttttgagaaaaattttgca

SEQ ID NO: 3457 - DNA, 19 bp, Vaccinia Virus
ctgcaggtctgggctgcca

SEQ ID NO: 3458 - DNA, 16 bp, Vaccinia Virus
ccaggaacactccttc

SEQ ID NO: 3459 - DNA, 19 bp, Vaccinia Virus
ttctgttgcctaaggcagc

SEQ ID NO: 3460 - DNA, 21 bp, Vaccinia Virus
gctttaaaactaattacttca

SEQ ID NO: 3461 - DNA, 19 bp, Vaccinia Virus
tagaagagagagactttaa

SEQ ID NO: 3462 - DNA, 23 bp, Vaccinia Virus
ctccagacccagatggtgtctca

SEQ ID NO: 3463 - DNA, 19 bp, Vaccinia Virus
ttgcatgttaaatgatact

SEQ ID NO: 3464 - DNA, 23 bp, Vaccinia Virus
catttaggaagcaagatgtctag

SEQ ID NO: 3465 - DNA, 24 bp, Vaccinia Virus
tattttttaaaagtctttctctct

SEQ ID NO: 3466 - DNA, 19 bp, Vaccinia Virus
aatgatctagtcagaagct

SEQ ID NO: 3467 - DNA, 18 bp, Vaccinia Virus
tctgcatccatgtactcc

SEQ ID NO: 3468 - DNA, 18 bp, Vaccinia Virus
cacacgtatgccatggcc

SEQ ID NO: 3469 - DNA, 21 bp, Vaccinia Virus
atgacttggaactgaactaac

SEQ ID NO: 3470 - DNA, 22 bp, Vaccinia Virus
gggcacatagagctataaataa

SEQ ID NO: 3471 - DNA, 16 bp, Vaccinia Virus
agaaaactttccattc

SEQ ID NO: 3472 - DNA, 22 bp, Vaccinia Virus
caactgaggtctgtaagactta

SEQ ID NO: 3473 - DNA, 17 bp, Vaccinia Virus
attcaaaacacacattc

SEQ ID NO: 3474 - DNA, 20 bp, Vaccinia Virus
aaggggcccccatgggacaa

SEQ ID NO: 3475 - DNA, 18 bp, Vaccinia Virus
gaagttcacaggtatatc

SEQ ID NO: 3476 - DNA, 21 bp, Vaccinia Virus
tcttagaagaaaacatagacg

SEQ ID NO: 3477 - DNA, 16 bp, Vaccinia Virus
agtcatgatcatgccg

SEQ ID NO: 3478 - DNA, 17 bp, Vaccinia Virus
gaaatgagtctgtggga

SEQ ID NO: 3479 - DNA, 22 bp, Vaccinia Virus
ccaccaccaatggtcaagatat

SEQ ID NO: 3480 - DNA, 20 bp, Vaccinia Virus
gctaatgggctgactactca

SEQ ID NO: 3481 - DNA, 23 bp, Vaccinia Virus
aggcctcagagggccctagggac

SEQ ID NO: 3482 - DNA, 17 bp, Vaccinia Virus
cccctccacctgctcca

SEQ ID NO: 3483 - DNA, 17 bp, Vaccinia Virus
cagaggcatcttctgga

SEQ ID NO: 3484 - DNA, 21 bp, Vaccinia Virus
gaaacaaatacccagaagaca

SEQ ID NO: 3485 - DNA, 21 bp, Vaccinia Virus
gcatctgttcaggacaacatc

SEQ ID NO: 3486 - DNA, 21 bp, Vaccinia Virus
aaaaagcaagtatcatttgga

SEQ ID NO: 3487 - DNA, 22 bp, Vaccinia Virus
cagctccgaccacaccatcctc

SEQ ID NO: 3488 - DNA, 16 bp, Vaccinia Virus
gatcctgaaatcaagg

SEQ ID NO: 3489 - DNA, 20 bp, Vaccinia Virus
agctcctaggaattctctca

SEQ ID NO: 3490 - DNA, 19 bp, Vaccinia Virus
agctcctagaggctgctca

SEQ ID NO: 3491 - DNA, 19 bp, Vaccinia Virus
gtttctaaagagtcttcaa

SEQ ID NO: 3492 - DNA, 18 bp, Vaccinia Virus
gaaaacaagagtagaggc

SEQ ID NO: 3493 - DNA, 18 bp, Vaccinia Virus
ctctggaaaggtctccaa

SEQ ID NO: 3494 - DNA, 18 bp, Vaccinia Virus
gaaaaggcctctgtggag

SEQ ID NO: 3495 - DNA, 19 bp, Vaccinia Virus
ttttggtggctcgatgtta

SEQ ID NO: 3496 - DNA, 18 bp, Vaccinia Virus
atttcccgtgaacaccca

SEQ ID NO: 3497 - DNA, 18 bp, Vaccinia Virus
gcgattagaaaaacacta

SEQ ID NO: 3498 - DNA, 19 bp, Vaccinia Virus
atggacttcttcatctgta

SEQ ID NO: 3499 - DNA, 22 bp, Vaccinia Virus
tctggatttcaccactcagagg

SEQ ID NO: 3500 - DNA, 23 bp, Vaccinia Virus
gtaattggaaaaaatccaataaa

SEQ ID NO: 3501 - DNA, 18 bp, Vaccinia Virus
atctctattctacattta

SEQ ID NO: 3502 - DNA, 21 bp, Vaccinia Virus
gttaaatgtgatgaatactgt

SEQ ID NO: 3503 - DNA, 20 bp, Vaccinia Virus
ttgcaaggaaggcctaatca

SEQ ID NO: 3504 - DNA, 22 bp, Vaccinia Virus
atgaaatgatttttataattct

SEQ ID NO: 3505 - DNA, 18 bp, Vaccinia Virus
aaaggtgtatttaaacta

SEQ ID NO: 3506 - DNA, 22 bp, Vaccinia Virus
aatcatctcaccccgaaatgca

SEQ ID NO: 3507 - DNA, 26 bp, Vaccinia Virus
cattaaaaagaaaatattgaaaggaa

SEQ ID NO: 3508 - DNA, 19 bp, Vaccinia Virus
aaataatcaaaacccaaca

SEQ ID NO: 3509 - DNA, 20 bp, Vaccinia Virus
ttcctattataattacatct

SEQ ID NO: 3510 - DNA, 21 bp, Vaccinia Virus
cagctctggccacaatcctcc

SEQ ID NO: 3511 - DNA, 19 bp, Vaccinia Virus
gcagagggaaccagcttca

SEQ ID NO: 3512 - DNA, 16 bp, Vaccinia Virus
tctacgatgctacaaa

SEQ ID NO: 3513 - DNA, 19 bp, Vaccinia Virus
aattgttgcctagtcctgc

SEQ ID NO: 3514 - DNA, 19 bp, Vaccinia Virus
aatgtcttagttgtacaaa

SEQ ID NO: 3515 - DNA, 19 bp, Vaccinia Virus
gtgactgtggagcctgaga

SEQ ID NO: 3516 - DNA, 19 bp, Vaccinia Virus
atttttgttatctctcttc

SEQ ID NO: 3517 - DNA, 19 bp, Vaccinia Virus
tagtcacaaatcagaactg

SEQ ID NO: 3518 - DNA, 18 bp, Vaccinia Virus
tataccttagaacattga

SEQ ID NO: 3519 - DNA, 17 bp, Vaccinia Virus
aggcagaagaatcactt

SEQ ID NO: 3520 - DNA, 18 bp, Vaccinia Virus
gagaataaaaataattta

SEQ ID NO: 3521 - DNA, 22 bp, Vaccinia Virus
atgcctataattaggaaggagt

SEQ ID NO: 3522 - DNA, 19 bp, Vaccinia Virus
cgtatgattttatttcata

SEQ ID NO: 3523 - DNA, 19 bp, Vaccinia Virus
tcccctctgtgtctccatg

SEQ ID NO: 3524 - DNA, 22 bp, Vaccinia Virus
ttgtgtgagaggaacccaaaga

SEQ ID NO: 3525 - DNA, 18 bp, Vaccinia Virus
agaaaagaagacttcaat

SEQ ID NO: 3526 - DNA, 23 bp, Vaccinia Virus
aactaaactacttgttgtgttga

SEQ ID NO: 3527 - DNA, 19 bp, Vaccinia Virus
tagaaatagagatgcttta

SEQ ID NO: 3528 - DNA, 19 bp, Vaccinia Virus
ggtgacagagtaggtgctc

SEQ ID NO: 3529 - DNA, 23 bp, Vaccinia Virus
cggtggttaaaacaacaataata

SEQ ID NO: 3530 - DNA, 20 bp, Vaccinia Virus
tagagaagggaaagacttta

SEQ ID NO: 3531 - DNA, 23 bp, Vaccinia Virus
tgaatctgccagcaccagaactt

SEQ ID NO: 3532 - DNA, 19 bp, Vaccinia Virus
aatggtcatcttatcaata

SEQ ID NO: 3533 - DNA, 22 bp, Vaccinia Virus
aattaatgacagctttgaagat

SEQ ID NO: 3534 - DNA, 23 bp, Vaccinia Virus
atgcctacagtgtctgtattaga

SEQ ID NO: 3535 - DNA, 20 bp, Vaccinia Virus
gaaagcacaaaatttgtagc

SEQ ID NO: 3536 - DNA, 16 bp, Vaccinia Virus
aaaggaatcacatgaa

SEQ ID NO: 3537 - DNA, 18 bp, Vaccinia Virus
ttcccctccatctgatcc

SEQ ID NO: 3538 - DNA, 16 bp, Vaccinia Virus
actaaaactgaatttg

SEQ ID NO: 3539 - DNA, 20 bp, Vaccinia Virus
gtcacagattttgaaagcta

SEQ ID NO: 3540 - DNA, 18 bp, Vaccinia Virus
ggcaaagtctcacctgaa

SEQ ID NO: 3541 - DNA, 24 bp, Vaccinia Virus
acaaatcctacagtcaatagctaa

SEQ ID NO: 3542 - DNA, 20 bp, Vaccinia Virus
gaatactaacaggtatttca

SEQ ID NO: 3543 - DNA, 22 bp, Vaccinia Virus
gtatgtcaaagaataaattagt

SEQ ID NO: 3544 - DNA, 18 bp, Vaccinia Virus
tcctcacttctccatcca

SEQ ID NO: 3545 - DNA, 19 bp, Vaccinia Virus
aaatggcaaacaggtatat

SEQ ID NO: 3546 - DNA, 22 bp, Vaccinia Virus
atgatcctgaagaaaaaggtga

SEQ ID NO: 3547 - DNA, 23 bp, Vaccinia Virus
tatgtctgcattgaaaagaacca

SEQ ID NO: 3548 - DNA, 22 bp, Vaccinia Virus
aaccattagacaaaactcttct

SEQ ID NO: 3549 - DNA, 21 bp, Vaccinia Virus
gctgaggtcacagccggaggc

SEQ ID NO: 3550 - DNA, 17 bp, Vaccinia Virus
tcccctctgccacccca

SEQ ID NO: 3551 - DNA, 17 bp, Vaccinia Virus
agatgtggctacaacat

SEQ ID NO: 3552 - DNA, 21 bp, Vaccinia Virus
ttggaaattgaagctgtagag

SEQ ID NO: 3553 - DNA, 21 bp, Vaccinia Virus
tatatcaggtcataaataata

SEQ ID NO: 3554 - DNA, 19 bp, Vaccinia Virus
taggttgatacatgtatca

SEQ ID NO: 3555 - DNA, 19 bp, Vaccinia Virus
atctctgttctctaagcac

SEQ ID NO: 3556 - DNA, 20 bp, Vaccinia Virus
tagttcaagtaaacacaatg

SEQ ID NO: 3557 - DNA, 23 bp, Vaccinia Virus
aagtatactactctcaaaggtgt

SEQ ID NO: 3558 - DNA, 18 bp, Vaccinia Virus
gctaatgaaagagattct

SEQ ID NO: 3559 - DNA, 23 bp, Vaccinia Virus
aaaatttttctaaaactccatca

SEQ ID NO: 3560 - DNA, 18 bp, Vaccinia Virus
accaactggggaactgtg

SEQ ID NO: 3561 - DNA, 19 bp, Vaccinia Virus
atatcacagagcctgggag

SEQ ID NO: 3562 - DNA, 20 bp, Vaccinia Virus
tttggaatgtatcatatgta

SEQ ID NO: 3563 - DNA, 18 bp, Vaccinia Virus
cagaggcgccatcttgga

SEQ ID NO: 3564 - DNA, 18 bp, Vaccinia Virus
atgatgtaaatccaccca

SEQ ID NO: 3565 - DNA, 22 bp, Vaccinia Virus
ggaagggaaaaatttatagcta

SEQ ID NO: 3566 - DNA, 20 bp, Vaccinia Virus
tgatgtctgaagataatgct

SEQ ID NO: 3567 - DNA, 19 bp, Vaccinia Virus
tattttcttttctttcttc

SEQ ID NO: 3568 - DNA, 18 bp, Vaccinia Virus
ggtacttttctcatcaca

SEQ ID NO: 3569 - DNA, 20 bp, Vaccinia Virus
ttgtgtgaaattttgtcgaa

SEQ ID NO: 3570 - DNA, 17 bp, Vaccinia Virus
gtcatatgacagggctg

SEQ ID NO: 3571 - DNA, 16 bp, Vaccinia Virus
attgaaactgctagtg

SEQ ID NO: 3572 - DNA, 20 bp, Vaccinia Virus
ggtaatttaagtgttgaagt

SEQ ID NO: 3573 - DNA, 20 bp, Vaccinia Virus
attttaatacacttccctca

SEQ ID NO: 3574 - DNA, 25 bp, Vaccinia Virus
tcctgcaaaccaccttctccaatca

SEQ ID NO: 3575 - DNA, 19 bp, Vaccinia Virus
gaatatttacacaatgcct

SEQ ID NO: 3576 - DNA, 23 bp, Vaccinia Virus
ctccagacccagatggtgtctca

SEQ ID NO: 3577 - DNA, 22 bp, Vaccinia Virus
acagtgttcatagtttatatta

SEQ ID NO: 3578 - DNA, 18 bp, Vaccinia Virus
ttgtattagtatattcta

SEQ ID NO: 3579 - DNA, 20 bp, Vaccinia Virus
atgaagcaaacacacgtagg

SEQ ID NO: 3580 - DNA, 20 bp, Vaccinia Virus
tcgtgggcccgcacttcata

SEQ ID NO: 3581 - DNA, 17 bp, Vaccinia Virus
tctcagaatatgtccat

SEQ ID NO: 3582 - DNA, 18 bp, Vaccinia Virus
gcttctacgactccgcca

SEQ ID NO: 3583 - DNA, 24 bp, Vaccinia Virus
ataaaaaaacaaaaatggaaatga

SEQ ID NO: 3584 - DNA, 24 bp, Vaccinia Virus
tgaaaaaggagagatcatcagcca

SEQ ID NO: 3585 - DNA, 19 bp, Vaccinia Virus
acttaccgatagtttcagt

SEQ ID NO: 3586 - DNA, 20 bp, Vaccinia Virus
tccaccctttgtgctttggt

SEQ ID NO: 3587 - DNA, 19 bp, Vaccinia Virus
aatttgacatcacatttta

SEQ ID NO: 3588 - DNA, 23 bp, Vaccinia Virus
ggaaaggacaaaatggagagtga

SEQ ID NO: 3589 - DNA, 22 bp, Vaccinia Virus
aagacatgtgatttgtatttta

SEQ ID NO: 3590 - DNA, 23 bp, Vaccinia Virus
ccactgtgggaaccaaattggat

SEQ ID NO: 3591 - DNA, 17 bp, Vaccinia Virus
ggtcatagactatggaa

SEQ ID NO: 3592 - DNA, 18 bp, Vaccinia Virus
agccacgtgagccatgcc

SEQ ID NO: 3593 - DNA, 16 bp, Vaccinia Virus
tcccagtattaaacct

SEQ ID NO: 3594 - DNA, 22 bp, Vaccinia Virus
agaatatcacattattcaatgc

SEQ ID NO: 3595 - DNA, 20 bp, Vaccinia Virus
agaagaaaagtttgaaacca

SEQ ID NO: 3596 - DNA, 20 bp, Vaccinia Virus
tgctgtctctgcagtactga

SEQ ID NO: 3597 - DNA, 22 bp, Vaccinia Virus
tgatgccctgtcctcacctctg

SEQ ID NO: 3598 - DNA, 19 bp, Vaccinia Virus
caacaagcggggggtcata

SEQ ID NO: 3599 - DNA, 19 bp, Vaccinia Virus
aatgacttggggatgatgc

SEQ ID NO: 3600 - DNA, 19 bp, Vaccinia Virus
cataatattttaaaacatt

SEQ ID NO: 3601 - DNA, 18 bp, Vaccinia Virus
ctccagagtgggtgtcca

SEQ ID NO: 3602 - DNA, 20 bp, Vaccinia Virus
tagagaagggaaagacttta

SEQ ID NO: 3603 - DNA, 23 bp, Vaccinia Virus
tgaatctgccagcagcagaactt

SEQ ID NO: 3604 - DNA, 18 bp, Vaccinia Virus
agtcacttctccatcaca

SEQ ID NO: 3605 - DNA, 18 bp, Vaccinia Virus
cagatgcagagaaagcta

SEQ ID NO: 3606 - DNA, 21 bp, Vaccinia Virus
cctgctccctacttcctggca

SEQ ID NO: 3607 - DNA, 20 bp, Vaccinia Virus
cattaaaaaaaaacatgccg

SEQ ID NO: 3608 - DNA, 21 bp, Vaccinia Virus
ctaatgaagagaatatttaac

SEQ ID NO: 3609 - DNA, 20 bp, Vaccinia Virus
gaaagagggatgctacacgg

SEQ ID NO: 3610 - DNA, 19 bp, Vaccinia Virus
ctcccgagatggtgtcaca

SEQ ID NO: 3611 - DNA, 19 bp, Vaccinia Virus
ctcccgagatggtgtcaca

SEQ ID NO: 3612 - DNA, 18 bp, Vaccinia Virus
ctagacaattttttttag

SEQ ID NO: 3613 - DNA, 21 bp, Vaccinia Virus
gaaaaggaaaagtttacctgc

SEQ ID NO: 3614 - DNA, 17 bp, Vaccinia Virus
gaaaaggaaagtagcta

SEQ ID NO: 3615 - DNA, 22 bp, Vaccinia Virus
tgacaccaacttttgagattta

SEQ ID NO: 3616 - DNA, 20 bp, Vaccinia Virus
tgtctgctctgtaccagaga

SEQ ID NO: 3617 - DNA, 19 bp, Vaccinia Virus
tccaaccacattggtaaaa

SEQ ID NO: 3618 - DNA, 15 bp, Vaccinia Virus
ctcaggatccataga

SEQ ID NO: 3619 - DNA, 20 bp, Vaccinia Virus
aacaaattgcatggatttgt

SEQ ID NO: 3620 - DNA, 21 bp, Vaccinia Virus
gaatatgggctacttcatatg

SEQ ID NO: 3621 - DNA, 20 bp, Vaccinia Virus
ttctcataaatccccgccca

SEQ ID NO: 3622 - DNA, 18 bp, Vaccinia Virus
cactcaagtcattaggga

SEQ ID NO: 3623 - DNA, 17 bp, Vaccinia Virus
aagggactatttgtatt

SEQ ID NO: 3624 - DNA, 23 bp, Vaccinia Virus
aactaaacctaatgctgctgtta

SEQ ID NO: 3625 - DNA, 20 bp, Vaccinia Virus
agtctttaaaatatattctg

SEQ ID NO: 3626 - DNA, 21 bp, Vaccinia Virus
acttaaggatccttctagtca

SEQ ID NO: 3627 - DNA, 17 bp, Vaccinia Virus
ggaaacagaaacataga

SEQ ID NO: 3628 - DNA, 22 bp, Vaccinia Virus
gccagtaatagtcaaattaacc

SEQ ID NO: 3629 - DNA, 19 bp, Vaccinia Virus
ccaagttagatgtcatcaa

SEQ ID NO: 3630 - DNA, 21 bp, Vaccinia Virus
ctcaacaattttgtattccca

SEQ ID NO: 3631 - DNA, 23 bp, Vaccinia Virus
ttctaagtagttaaaattagaaa

SEQ ID NO: 3632 - DNA, 22 bp, Vaccinia Virus
ccgctaatttttgtatttttgg

SEQ ID NO: 3633 - DNA, 18 bp, Vaccinia Virus
agaccatgcatactgata

SEQ ID NO: 3634 - DNA, 20 bp, Vaccinia Virus
attctgtgggctgatgagaa

SEQ ID NO: 3635 - DNA, 18 bp, Vaccinia Virus
attttaccttctctcttt

SEQ ID NO: 3636 - DNA, 19 bp, Vaccinia Virus
tgaggccccagaggactta

SEQ ID NO: 3637 - DNA, 23 bp, Vaccinia Virus
acatcatctgttcttggacctca

SEQ ID NO: 3638 - DNA, 19 bp, Vaccinia Virus
gcatttagtagacaccacg

SEQ ID NO: 3639 - DNA, 20 bp, Vaccinia Virus
cagacatgtgcccagcacct

SEQ ID NO: 3640 - DNA, 20 bp, Vaccinia Virus
tatgttgaattatgtcagtg

SEQ ID NO: 3641 - DNA, 23 bp, Vaccinia Virus
ttatcacatggtcaagtaccttg

SEQ ID NO: 3642 - DNA, 26 bp, Vaccinia Virus
atccaactagttgctggtctctatca

SEQ ID NO: 3643 - DNA, 20 bp, Vaccinia Virus
agctgcaaacacagagccca

SEQ ID NO: 3644 - DNA, 23 bp, Vaccinia Virus
tacagtctcacactgctatcgta

SEQ ID NO: 3645 - DNA, 18 bp, Vaccinia Virus
agcaagatgggtaacatc

SEQ ID NO: 3646 - DNA, 20 bp, Vaccinia Virus
aggctgatgccccaaaaggc

SEQ ID NO: 3647 - DNA, 21 bp, Vaccinia Virus
tctgtaacaaattaccacaaa

SEQ ID NO: 3648 - DNA, 22 bp, Vaccinia Virus
ctcagcagagacagaccccaga

SEQ ID NO: 3649 - DNA, 20 bp, Vaccinia Virus
gcactttcaaagaatcatcc

SEQ ID NO: 3650 - DNA, 18 bp, Vaccinia Virus
agctgggcctagtcaact

SEQ ID NO: 3651 - DNA, 19 bp, Vaccinia Virus
gtctacaattcccaaaaga

SEQ ID NO: 3652 - DNA, 21 bp, Vaccinia Virus
tcagggatctagaactagaaa

SEQ ID NO: 3653 - DNA, 24 bp, Vaccinia Virus
tattttcttcccctacctctcttc

SEQ ID NO: 3654 - DNA, 17 bp, Vaccinia Virus
cactgggacggaatcgg

SEQ ID NO: 3655 - DNA, 18 bp, Vaccinia Virus
ttttttattaaacgatgt

SEQ ID NO: 3656 - DNA, 18 bp, Vaccinia Virus
tgggaggacaaaggcagt

SEQ ID NO: 3657 - DNA, 20 bp, Vaccinia Virus
gtgactgtaatatactagag

SEQ ID NO: 3658 - DNA, 19 bp, Vaccinia Virus
tctgttttttctaccctag

SEQ ID NO: 3659 - DNA, 21 bp, Vaccinia Virus
tggaaaagaatccctgcagcc

SEQ ID NO: 3660 - DNA, 17 bp, Vaccinia Virus
agccacagaggcctgcc

SEQ ID NO: 3661 - DNA, 19 bp, Vaccinia Virus
tgtctatctcaactctatt

SEQ ID NO: 3662 - DNA, 26 bp, Vaccinia Virus
acaaagatggctatcggtatattcta

SEQ ID NO: 3663 - DNA, 16 bp, Vaccinia Virus
ctgttgttcagcagtg

SEQ ID NO: 3664 - DNA, 16 bp, Vaccinia Virus
ctgttgttcagcagtg

SEQ ID NO: 3665 - DNA, 21 bp, Vaccinia Virus
tccaccctgggtaataaaaga

SEQ ID NO: 3666 - DNA, 21 bp, Vaccinia Virus
ttaaatattcagaaccgagga

SEQ ID NO: 3667 - DNA, 23 bp, Vaccinia Virus
atctttctctctagtctttctca

SEQ ID NO: 3668 - DNA, 22 bp, Vaccinia Virus
atgaataaaaatacatctactg

SEQ ID NO: 3669 - DNA, 17 bp, Vaccinia Virus
agtcatggagaccagcc

SEQ ID NO: 3670 - DNA, 17 bp, Vaccinia Virus
agtaaaagttttagcca

SEQ ID NO: 3671 - DNA, 19 bp, Vaccinia Virus
ttctcacagatgggcagca

SEQ ID NO: 3672 - DNA, 18 bp, Vaccinia Virus
cgtacggaaaagtcttca

SEQ ID NO: 3673 - DNA, 18 bp, Vaccinia Virus
ggaaaaggaagaaagcca

SEQ ID NO: 3674 - DNA, 22 bp, Vaccinia Virus
acaactgacagcagccagctca

SEQ ID NO: 3675 - DNA, 24 bp, Vaccinia Virus
aatatttttaaatgttgtctctct

SEQ ID NO: 3676 - DNA, 25 bp, Vaccinia Virus
ctttaattttaaaaaacgtattcca

SEQ ID NO: 3677 - DNA, 22 bp, Vaccinia Virus
ctgttgacccatgtccacctat

SEQ ID NO: 3678 - DNA, 21 bp, Vaccinia Virus
aaaaattgggatatgttatct

SEQ ID NO: 3679 - DNA, 19 bp, Vaccinia Virus
cacacgctcccgccagcga

SEQ ID NO: 3680 - DNA, 20 bp, Vaccinia Virus
gctaagggtgaaacttttca

SEQ ID NO: 3681 - DNA, 23 bp, Vaccinia Virus
tattttgacatctctctctcttc

SEQ ID NO: 3682 - DNA, 22 bp, Vaccinia Virus
caggaatgtgtcatttcccaca

SEQ ID NO: 3683 - DNA, 18 bp, Vaccinia Virus
gaaattaatcctttgtgg

SEQ ID NO: 3684 - DNA, 19 bp, Vaccinia Virus
gaataaaagccagagactg

SEQ ID NO: 3685 - DNA, 17 bp, Vaccinia Virus
tgactttcaccaattta

SEQ ID NO: 3686 - DNA, 23 bp, Vaccinia Virus
ctccagacccagatggtgtctca

SEQ ID NO: 3687 - DNA, 18 bp, Vaccinia Virus
ggaaaaggaagaaagcca

SEQ ID NO: 3688 - DNA, 20 bp, Vaccinia Virus
tagagaagggaaagacttta

SEQ ID NO: 3689 - DNA, 23 bp, Vaccinia Virus
tgaatctgccaacaccagaactt

SEQ ID NO: 3690 - DNA, 18 bp, Vaccinia Virus
aaaagagctctattagga

SEQ ID NO: 3691 - DNA, 16 bp, Vaccinia Virus
atggacttaatctctg

SEQ ID NO: 3692 - DNA, 18 bp, Vaccinia Virus
taatgtttccaacatgaa

SEQ ID NO: 3693 - DNA, 25 bp, Vaccinia Virus
gaaaaaacaaaaagttatatatgaa

SEQ ID NO: 3694 - DNA, 22 bp, Vaccinia Virus
ttgaaaaaaataaatgtacatt

SEQ ID NO: 3695 - DNA, 19 bp, Vaccinia Virus
ttgcatgttaaatgatact

SEQ ID NO: 3696 - DNA, 23 bp, Vaccinia Virus
ttcctattactctgcatatctta

SEQ ID NO: 3697 - DNA, 20 bp, Vaccinia Virus
cagctccaccatatttctcc

SEQ ID NO: 3698 - DNA, 19 bp, Vaccinia Virus
tctgtaccttctccatcca

SEQ ID NO: 3699 - DNA, 22 bp, Vaccinia Virus
aatttcttcactgactccacca

SEQ ID NO: 3700 - DNA, 18 bp, Vaccinia Virus
agccacagaaaatatacc

SEQ ID NO: 3701 - DNA, 19 bp, Vaccinia Virus
tttaggccccaatacctta

SEQ ID NO: 3702 - DNA, 17 bp, Vaccinia Virus
tgctgggctttagcaaa

SEQ ID NO: 3703 - DNA, 22 bp, Vaccinia Virus
ataaaaaaggtacaaaaagtga

SEQ ID NO: 3704 - DNA, 21 bp, Vaccinia Virus
cagccccagctgctcctcctc

SEQ ID NO: 3705 - DNA, 20 bp, Vaccinia Virus
ctcattcgagaccccataga

SEQ ID NO: 3706 - DNA, 19 bp, Vaccinia Virus
tgagcagctcctggaagac

SEQ ID NO: 3707 - DNA, 17 bp, Vaccinia Virus
agtcacagagaggtgcc

SEQ ID NO: 3708 - DNA, 21 bp, Vaccinia Virus
gaaacgagaacaatgacatta

SEQ ID NO: 3709 - DNA, 22 bp, Vaccinia Virus
tattgaaaggaaagtgctatcg

SEQ ID NO: 3710 - DNA, 22 bp, Vaccinia Virus
tattgaaagggctgcaccatgc

SEQ ID NO: 3711 - DNA, 17 bp, Vaccinia Virus
agaatcacctctaatcc

SEQ ID NO: 3712 - DNA, 20 bp, Vaccinia Virus
agttctttaaaaatattcta

SEQ ID NO: 3713 - DNA, 18 bp, Vaccinia Virus
atggagtctccctctgtc

SEQ ID NO: 3714 - DNA, 21 bp, Vaccinia Virus
aataataacatatacaattaa

SEQ ID NO: 3715 - DNA, 22 bp, Vaccinia Virus
cctgccccctaccctgttctcc

SEQ ID NO: 3716 - DNA, 20 bp, Vaccinia Virus
agatatgtaaacactggtac

SEQ ID NO: 3717 - DNA, 17 bp, Vaccinia Virus
aggtaaagactttagta

SEQ ID NO: 3718 - DNA, 21 bp, Vaccinia Virus
aggcccacataaaataccaac

SEQ ID NO: 3719 - DNA, 18 bp, Vaccinia Virus
attctgagtgatgatgaa

SEQ ID NO: 3720 - DNA, 23 bp, Vaccinia Virus
ctccagacccagatggtgtctca

SEQ ID NO: 3721 - DNA, 18 bp, Vaccinia Virus
gaaaagacaaagtcctcg

SEQ ID NO: 3722 - DNA, 21 bp, Vaccinia Virus
tgaagcaagagacagacccac

SEQ ID NO: 3723 - DNA, 19 bp, Vaccinia Virus
gccgtctcacctccaaagg

SEQ ID NO: 3724 - DNA, 20 bp, Vaccinia Virus
tgagaaaaacccacaactaa

SEQ ID NO: 3725 - DNA, 18 bp, Vaccinia Virus
gagttcaaaagtaccaca

SEQ ID NO: 3726 - DNA, 21 bp, Vaccinia Virus
taatgctacatggaacatgaa

SEQ ID NO: 3727 - DNA, 25 bp, Vaccinia Virus
aaggatttcagtattcatgggacaa

SEQ ID NO: 3728 - DNA, 21 bp, Vaccinia Virus
gaaaccattgcaggtatttca

SEQ ID NO: 3729 - DNA, 18 bp, Vaccinia Virus
ttctctccttctctcttc

SEQ ID NO: 3730 - DNA, 20 bp, Vaccinia Virus
aacatgactaacggatattc

SEQ ID NO: 3731 - DNA, 18 bp, Vaccinia Virus
aatcaacacccttgcccc

SEQ ID NO: 3732 - DNA, 19 bp, Vaccinia Virus
agagaaagtcttgcttttt

SEQ ID NO: 3733 - DNA, 18 bp, Vaccinia Virus
ttctattttccccacaaa

SEQ ID NO: 3734 - DNA, 18 bp, Vaccinia Virus
gcagaggcaccatcttgg

SEQ ID NO: 3735 - DNA, 16 bp, Vaccinia Virus
ttctaaccaccacaag

SEQ ID NO: 3736 - DNA, 18 bp, Vaccinia Virus
ctaagttaagacttttca

SEQ ID NO: 3737 - DNA, 17 bp, Vaccinia Virus
tatctctgttttggcat

SEQ ID NO: 3738 - DNA, 21 bp, Vaccinia Virus
gctaataatgatggcctctca

SEQ ID NO: 3739 - DNA, 17 bp, Vaccinia Virus
cctgtcaggatccgagt

SEQ ID NO: 3740 - DNA, 17 bp, Vaccinia Virus
aagataatgccaactca

SEQ ID NO: 3741 - DNA, 20 bp, Vaccinia Virus
gctctatagaacatgtctac

SEQ ID NO: 3742 - DNA, 19 bp, Vaccinia Virus
ataaagttggatggaaagg

SEQ ID NO: 3743 - DNA, 22 bp, Vaccinia Virus
ttggaatctgtgctttgcagaa

SEQ ID NO: 3744 - DNA, 19 bp, Vaccinia Virus
ctcatggatgagtaccaca

SEQ ID NO: 3745 - DNA, 18 bp, Vaccinia Virus
tgggccagcagattctcc

SEQ ID NO: 3746 - DNA, 17 bp, Vaccinia Virus
tcccctctgccacccca

SEQ ID NO: 3747 - DNA, 20 bp, Vaccinia Virus
ttctcataaatccccgccca

SEQ ID NO: 3748 - DNA, 17 bp, Vaccinia Virus
tcccctctgccacccca

SEQ ID NO: 3749 - DNA, 18 bp, Vaccinia Virus
gcttctacgactccgcca

SEQ ID NO: 3750 - DNA, 20 bp, Vaccinia Virus
ttctcataaatccccgccca

SEQ ID NO: 3751 - DNA, 705 bp, Homo Sapiens
cccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcggtggttcatgcctgtaatcccagcatttttgggaggccgaggcgggtggatcacctgaggtcaggagttcgagaccaacctggccaacacggcgaaaccccgcctctactcaaatacaaaaattagccaggcttggtgacactcgcctgtggtcccagctactcaggaggctgaggcaggagaattgcttgaacccaggaagtggaggcttcagtgagctgagaacacgccactgcactccagtcctgggcaacagagcaagactctgtctcaggaaaaaaaaag

SEQ ID NO: 3752 - DNA, 1262 bp, Homo Sapiens
gcaaaaactggaagcattccctttgaaaactggcacaagacagggatgccctctctcaccgctcctattcaacatagtgttggaagttctggccagggcaattaggcaggagaaggaaataaagggtattcaattaggaaaagagcaagtcaaattgttcctgtttgcagatgacatgattgtatatctagaaaaccccattgtctcagccccaaatctccttaagctgataagcaacttcagcaaagtctcaggatacaaaataaatgtacaaaaatcacaagcattcttacacaccaacaacagaaaaacagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactttactacaaggctacagtaaccaaaacagcatggtactggtaccaaaacagagatatagatcaatggaacagaacagagccctcagaaataacgccgaatacctacaactatctgatctttgacaaacctgagaaaaacaagcaatggggaaaggattccctatttaataaatggtgctgggaaaactgactagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaaaaaaaaaaaaaaa

SEQ ID NO: 3753 - DNA, 1445 bp, Homo Sapiens
actcctatcaacagtgtaaaagcattcctgtttctccataatcttgccagcatcttttcatttttttgaattatagccattctgactgttgtgagatggtgtctcattgtggttttgatttgcatttctcagatgatcagtgatgttgaagtttttttgtttgttggctgcatgtatgccttcttttgaaaagtgtctgtttgtgtcctttgaccactttctaatggggttgagtttttttttcttgtaaatttgtttaagttccttgtagatgctggatattagacctttgtcagatggatagagtgcaaaaattttctcccattctgtaggttgtcggtttactctgttgataggttcttaatgctgtgcagaagctctttagtttaattagatcccatttgtcaattttggcttttgttgcaattgcttttggcatcttcgtcatgaaatctttgcccttgcctgtgtcctgaatggcattgcctaggttttcttccaggatttttatagttttgggttgtagatttaagtctttaatccatcttgagttaacttttgtatatgggttaaggaaggggcccgtttcaatttgctgcaaatggctagccagttctcccagcaccatttattaaatagggaatcttttccccattgcttccttttgtcaggtttgtcaaagatcacatggttgtaggtgtgtggtcttatttctgggttctctattctgttccattgggctatgggccggttctgtaccaccactatgctgttttgggtaccatagtcttgtagaatgtttgaagctgggtagcatgatgcctctagctttgctcttcttgctaagaaatgtcttggctatttgggctcttttttggttccatatgaattttaaaatagctttttctaggtctgtaaagaatgtgaatagtagtttaatgggcctagcatttaatttacagattgccttgggcagtgtggtcattttcacgatattgatccttcctgtctgtgagcatatgtttttccatttgtttgtgtcatctctgatttctttgaataatggtttatagttatccttgaaaaggtccttcacttttcttgttagctgtattcctagatattatactcttcttgtggcaattgtgaatgggagttaattcatgagttttctctcggcttgcctgttgttggtgtataggaatgctagtgacttttgcacattgattttgtatcctgagactttgttgaagttgcttatcagctaagaagtttttgagctgagatgatggagttttctagatataggatcatatcatctgcaaacaaagatagtttgacttcctgtcttcctatttgaatagcttttctttctttctcttgcctgattgccttggtgagaatttctaatactgtgttgaataggagtggtgagctcgtgccaa

SEQ ID NO: 3754 - DNA, 42 bp, Homo Sapiens
taatacgactcactatagggtgaggtagtaagttgtattgtt

SEQ ID NO: 3755 - DNA, 41 bp, Homo Sapiens
aattaaccctcactaaagggaaagtagtaagttgtatagtt

SEQ ID NO: 3756 - DNA, 40 bp, Homo Sapiens
taatacgactcactataggcccttattagaggattctgct

SEQ ID NO: 3757 - DNA, 41 bp, Homo Sapiens
aattaaccctcactaaaggtttttttttcctgagacagagt

SEQ ID NO: 3758 - DNA, 20 bp, Homo Sapiens
gaggcaggagaattgcttga

SEQ ID NO: 3759 - DNA, 39 bp, Homo Sapiens
aattaaccctcactaaaggcctgagacagagtcttgctc

SEQ ID NO: 3760 - DNA, 1623 bp, Vaccinia Virus
tctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtacgtagcgtacaaaatgattgttcctggtatatagataaagagtcctatatatttgaaaatcgttacggctcgattaaactttaatgattgcatagtgaatatatcattaggatttaactccttgactatcagggcggcaccagaaattaccatcaaaagcattaatacagttatgcctatcgcagttagaacggttatagcatccaccatttatatctaaaaattagatcaaagaatatgtgacaaagtcctagttgtatattgagaattgacaaaacaatgtttcttacatattttttttttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtg

The invention claimed is:

1. An isolated nucleic acid wherein the sequence of the nucleic acid consists of:
   (a) SEQ ID NOS: 128, 131, or 133;
   (b) an RNA encoded by the nucleic acid of (a); or
   (c) the complement of (a) or (b), wherein the complement is identical in length to (a) or (b).

2. An isolated nucleic acid, wherein the sequence of the nucleic acid consists of:
   (a) SEQ ID NO:477, SEQ ID NO:480, or SEQ ID NO:482;
   (b) an RNA encoded by the nucleic acid of (a); or
   (c) the complement of (a) or (b), wherein the complement is identical in length to (a) or (b).

3. A vector comprising a heterologous sequence, wherein the heterologous sequence consists of the sequence of the nucleic acid of claim 1.

4. A vector comprising a heterologous sequence, wherein the heterologous sequence consists of the sequence of the nucleic acid of claim 2.

5. A probe comprising a heterologous sequence, wherein the heterologous sequence consists of the sequence of the nucleic acid of claim 1.

6. A probe comprising a heterologous sequence, wherein the heterologous sequence consists of the sequence of the nucleic acid of claim 2.

* * * * *